US008580548B2

(12) United States Patent
Janulaitis et al.

(10) Patent No.: US 8,580,548 B2
(45) Date of Patent: *Nov. 12, 2013

(54) PRODUCTION OF NUCLEIC ACID

(75) Inventors: Arvydas Janulaitis, Vilnius (LT);
Remigijus Skirgaila, Vilnius (LT);
Dangira Siksniene, Vilnius (LT)

(73) Assignee: Thermo Fisher Scientific Baltics, UAB, Vilnius (LT)

( * ) Notice: Subject to any disclaimer, the term of this patent is extended or adjusted under 35 U.S.C. 154(b) by 0 days.

This patent is subject to a terminal disclaimer.

(21) Appl. No.: 13/408,732

(22) Filed: Feb. 29, 2012

(65) Prior Publication Data

US 2012/0156752 A1 Jun. 21, 2012

Related U.S. Application Data

(63) Continuation of application No. 12/899,641, filed on Oct. 7, 2010, and a continuation of application No. PCT/EP2009/054329, filed on Apr. 9, 2009.

(30) Foreign Application Priority Data

Apr. 10, 2008 (GB) ..................................... 0806562

(51) Int. Cl.
*C12N 9/12* (2006.01)
(52) U.S. Cl.
USPC .......................................................... 435/194
(58) Field of Classification Search
None
See application file for complete search history.

(56) References Cited

U.S. PATENT DOCUMENTS

| 5,244,797 | A | 9/1993 | Kotewicz et al. |
| 5,405,776 | A | 4/1995 | Kotewicz et al. |
| 6,063,608 | A | 5/2000 | Kotewicz et al. |
| 6,136,582 | A | 10/2000 | Gao et al. |
| 7,056,716 | B2 | 6/2006 | Potter et al. |
| 7,078,208 | B2 * | 7/2006 | Smith et al. ................... 435/194 |
| 2004/0209276 | A1 | 10/2004 | Smith et al. |
| 2005/0064460 | A1 | 3/2005 | Holliger et al. |
| 2005/0232934 | A1 | 10/2005 | Chen et al. |
| 2006/0094050 | A1 | 5/2006 | Potter et al. |
| 2007/0141592 | A1 | 6/2007 | Smith et al. |

FOREIGN PATENT DOCUMENTS

| EP | 0494955 | | 7/1998 |
| EP | 1019496 | | 9/2004 |
| EP | 1268766 | | 11/2005 |
| EP | 1712617 | | 10/2006 |
| WO | WO 00/42199 | * | 7/2000 |
| WO | 01/68895 | | 9/2001 |
| WO | 01/75097 | | 10/2001 |
| WO | 02/22869 | | 3/2002 |
| WO | 03/044187 | | 5/2003 |
| WO | 2004/024749 A2 | | 3/2004 |
| WO | 2004/024917 | | 3/2004 |
| WO | 2005/049787 | | 6/2005 |
| WO | 2006/051552 | | 5/2006 |
| WO | 2007/011045 A1 | | 1/2007 |
| WO | 2007/022045 | | 2/2007 |
| WO | 2007/022045 A2 | | 2/2007 |
| WO | WO2007022045 A2 | * | 2/2007 |
| WO | 2008/029085 | | 3/2008 |

OTHER PUBLICATIONS

International Search Report, PCT/EP2009/054329 (mailed Jan. 22, 2010; published Mar. 11, 2010).
Griffiths, et al., "Man-made enzymes—from design to in vitro compartmentalisation", Current Opinion in Biotechnology, vol. 11, No. 4, pp. 338-353, (Aug. 2000).
Griffiths, et al., "Directed evolution of an extremely fast phosphotriesterase by in vitro compartmentalization" The EMBO Journal, vol. 22, No. 1 pp. 24-35 (Jan. 2003).
Cohen, et al., "Altering the sequence specificity of HaeIII methyltransferase by directed evolution using in vitro compartmentalization, Protein Engineering Design & Selection", vol. 17, No, 1, pp. 3-11 (Jan. 2004).
Kelly et al., "Miniaturizing chemistry and biology in microdroplets", Chem Commun., No. 18, pp. 1773-1788 (May 2007).
International Search Report, GB0806562.5, Aug. 13, 2008.
International Search Report, GB0806562.5, Nov. 13, 2008.
Aharoni A et al. High-throughput screens and selections of enzyme-encoding genes. Curr. Opin. Chem. Biol., vol. 9, 2005, pp. 210-216.
Amstutz P, Pelletier JN, Guggisberg A, Jermutus L, Cesaro-Tadic S, Zahnd C, Pluckthun A. In vitro selection for catalytic activity with ribosome display. J Am Chem Soc. Aug. 14, 2002;124(32):9396-403.
AMV Reverse Transcriptase Certificate of Analysis, Fermentas Life Sciences, revised Nov. 22, 2006.
Bernath K, Hai M, Mastrobattista E, Griffiths AD, Magdassi S, Tawfik DS. In vitro compartmentalization by double emulsions: sorting and gene enrichment by fluorescence activated cell sorting. Anal Biochem. Feb. 1, 2004;325(1):151-7.
Bernath K, Magdassi S, Tawfik DS. Directed evolution of protein inhibitors of DNA-nucleases by in vitro compartmentalization (IVC) and nano-droplet delivery. J Mol Biol. Feb. 4, 2005;345(5):1015-26. EPUB Dec. 7, 2004.

(Continued)

*Primary Examiner* — Christina Bradley
*Assistant Examiner* — Lianko Garyu
(74) *Attorney, Agent, or Firm* — Thompson Hine LLP

(57) ABSTRACT

The present invention provides a process for the production of nucleic acid encoding a target protein, which comprises: (a) providing an array of RNA or DNA molecules including one or more encoding the target protein; (b) generating a target protein from the array to form RNA-protein or DNA-protein complexes in which the RNA or DNA molecule is non-covalently or covalently bound to the complex; (c) separating the complexes into compartments wherein most or all of the compartments contain no more than one complex; (d) subjecting the complexes to reaction conditions which allow target protein activity; and (e) selecting nucleic acid encoding the target protein on the basis of the activity associated therewith, wherein when the complex is a DNA-protein complex in which the DNA is non-covalently bound, step b) is performed in the absence of separate compartments for each complex.

6 Claims, 16 Drawing Sheets

(56) References Cited

OTHER PUBLICATIONS

Figure 1:
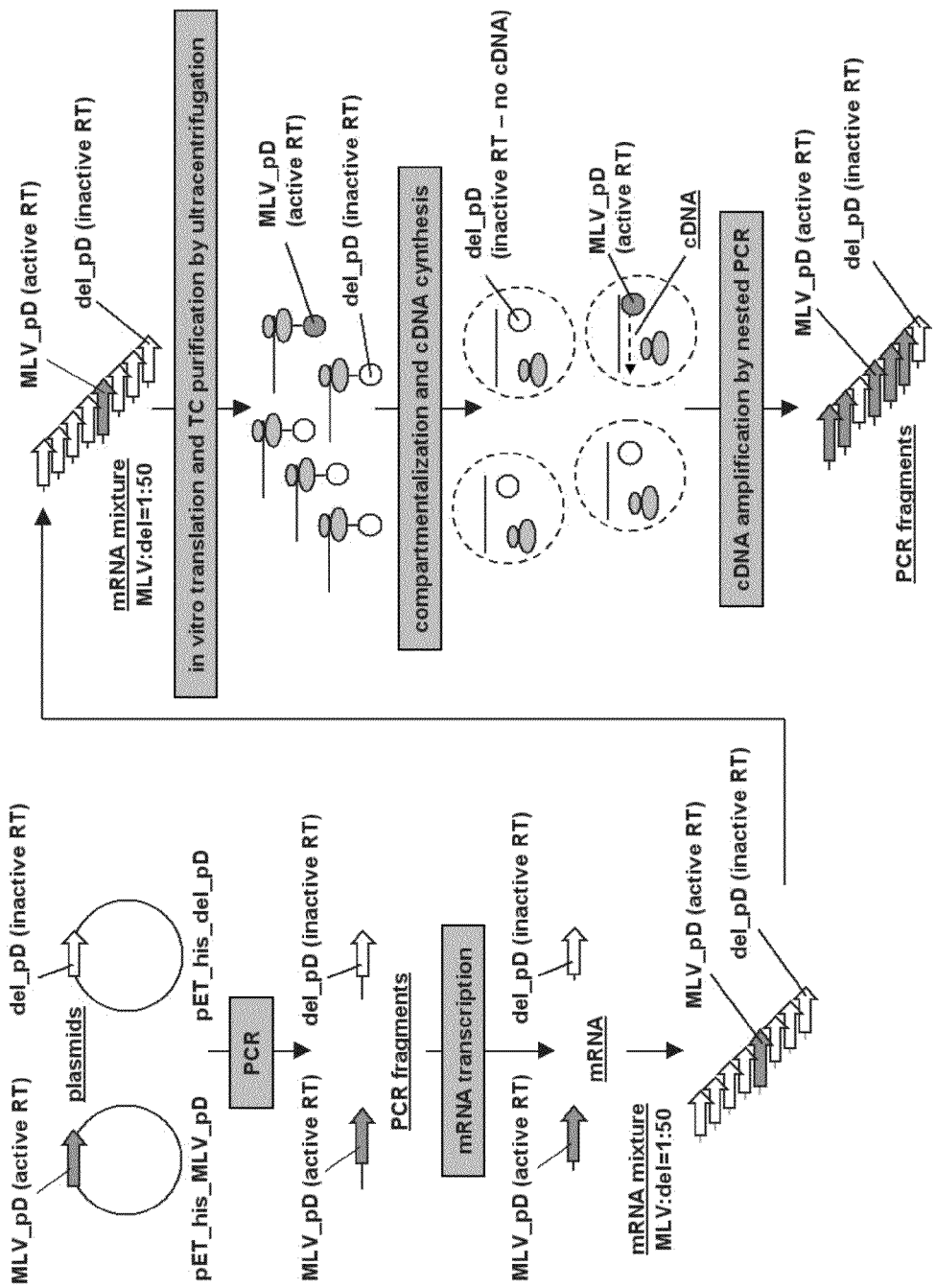

Bertschinger J, Neri D. Covalent DNA display as a novel tool for directed evolution of proteins in vitro. Protein Eng Des Sel. Sep. 2004;17(9):699-707. Epub Nov. 2, 2004.

Blain SW et al. Nuclease activities of Moloney murine leukemia virus reverse transcriptase. J.Biol. Chem. vol. 268, 1993, pp. 23585-23592.

Doi N, Yanagawa H. Stable: protein-DNA fusion system for screening of combinatorial protein libraries in vitro. FEBS Lett. Aug. 27, 1999;457(2):227-30.

Forrer P, Jaussi R. High-level expression of soluble heterologous proteins in the cytoplasm of Escherichia coli by fusion to the bacteriophage lambda head protein D. Gene. Dec. 11, 1998;224(1-2):45-52.

Gerard GF, D'Alessio JM, Kotewicz ML, Noon MC. Influence on stability in Escherichia coli of the carboxy-terminal structure of cloned Moloney murine leukemia virus reverse transcriptase. DNA. Aug. 1986;5(4):271-9.

Gerard GF, Potter RJ, Smith MD, Rosenthal K, Dhariwal G, Lee J, Chatterjee DK. The role of template-primer in protection of reverse transcriptase from thermal inactivation. Nucleic Acids Res. Jul. 15, 2002;30(14):3118-29.

Ghadessy FJ, Ong JL, Holliger P. Directed evolution of polymerase function by compartmentalized self-replication. Proc Natl Acad Sci U S A. Apr. 10, 2001;98(8):4552-7. Epub Mar. 27, 2001.

Ghadessy FJ, Ramsay N, Boudsocq F, Loakes D, Brown A, Iwai S, Vaisman A, Woodgate R, Holliger P. Generic expansion of the substrate spectrum of a DNA polymerase by directed evolution. Nat Biotechnol. Jun. 2004;22(6):755-9. Epub May 23, 2004.

Ghadessy FJ, Holliger P. A novel emulsion mixture for in vitro compartmentalization of transcription and translation in the rabbit reticulocyte system. Protein Eng Des Sel. Mar. 2004;17(3):201-4. Epub Feb. 27, 2004.

Goedken E R et al. Metal binding and activation of the ribonuclease H domain from Moloney murine leukemia virus. Protein Engineer., vol. 12, 1999, pp. 975-980.

Hanes J, Pluckthun A. In vitro selection and evolution of functional proteins by using ribosome display. Proc Natl Acad Sci U S A. May 13, 1997;94(10):4937-42.

He M, Taussig MJ. Antibody-ribosome-mRNA (ARM) complexes as efficient selection particles for in vitro display and evolution of antibody combining sites. Nucleic Acids Res. Dec. 15, 1997;25(24):5132-4.

Irving RA, Coia G, Roberts A, Nuttall SD, Hudson PJ. Ribosome display and affinity maturation: from antibodies to single V-domains and steps towards cancer therapeutics. J Immunol Methods. Feb. 1, 2001;248(1-2):31-45. Review.

Kelly B T et al. Selective gene amplification. Protein Engineer. Design Select., vol. 20, 2007, pp. 577-581.

Lee YF, Tawfik DS, Griffiths AD. Investigating the target recognition of DNA cytosine-5 methyltransferase HhaI by library selection using in vitro compartmentalisation. Nucleic Acids Res. Nov. 14, 2002;30(22):4937-44.

Lim D et al. Mutations of the RNase H C helix of the Moloney Murine Leukemia Virus Reverse Transcriptase Reveal Defects in Polypurine Tract Recognition, J.Virol., vol. 76, 2002, pp. 8360-8373.

Link DR, Grasland-Mongrain E, Duri A, Sarrazin F, Cheng Z, Cristobal G, Marquez M, Weitz DA. Electric control of droplets in microfluidic devices. Angew Chem Int Ed Engl. Apr. 10, 2006;45(16):2556-60.

Mastrobattista E, Taly V, Chanudet E, Treacy P, Kelly BT, Griffiths AD. High-throughput screening of enzyme libraries: in vitro evolution of a beta-galactosidase by fluorescence-activated sorting of double emulsions. Chem Biol. Dec. 2005;12(12):1291-300.

Mattheakis LC, Bhatt RR, Dower WJ. An in vitro polysome display system for identifying ligands from very large peptide libraries. Proc Natl Acad Sci U S A. Sep. 13, 1994;91(19):9022-6.

Matsuura T, Pluckthun A. Selection based on the folding properties of proteins with ribosome display. FEBS Lett. Mar. 27, 2003;539(1-3):24-8.

Matsuura T, Yanagida H, Ushioda J, Urabe I, Yomo T. Nascent chain, mRNA, and ribosome complexes generated by a pure translation system. Biochem Biophys Res Commun. Jan. 12, 2007;352(2):372-7. Epub Nov. 17, 2006.

Odegrip R, Coomber D, Eldridge B, Hederer R, Kuhlman PA, Ullman C, FitzGerald K, McGregor D. CIS display: In vitro selection of peptides from libraries of protein-DNA complexes. Proc Natl Acad Sci U S A. Mar. 2, 2004;101(9):2806-10. Epub Feb. 23, 2004.

Okushima S, Nisisako T, Torii T, Higuchi T. Controlled production of monodisperse double emulsions by two-step droplet breakup in microfluidic devices. Langmuir. Nov. 9, 2004;20(23):9905-8.

Ong JL, Loakes D, Jaroslawski S, Too K, Holliger P. Directed evolution of DNA polymerase, RNA polymerase and reverse transcriptase activity in a single polypeptide. J Mol Biol. Aug. 18, 2006;361(3):53750. Epub Jul. 5, 2006.

Reiersen H, Løbersli I, Løset GA, Hvattum E, Simonsen B, Stacy JE, McGregor D, Fitzgerald K, Welschof M, Brekke OH, Marvik OJ. Covalent antibody display—an in vitro antibody-DNA library selection system. Nucleic Acids Res. Jan. 14, 2005;33(1):e10.

Roberts RW, Szostak JW. RNA-peptide fusions for the in vitro selection of peptides and proteins. Proc Natl Acad Sci U S A. Nov. 11, 1997;94(23):12297-302.

Sepp A, Choo Y. Cell-free selection of zinc finger DNA-binding proteins using in vitro compartmentalization. J Mol Biol. Nov. 25, 2005;354(2):212-9. Epub Oct. 3, 2005.

Sepp A, Tawfik DS, Griffiths AD. Microbead display by in vitro compartmentalisation: selection for binding using flow cytometry. FEBS Lett. Dec. 18, 2002;532(3):455-8.

Song H, Tice JD, Ismagilov RF. A microfluidic system for controlling reaction networks in time. Angew Chem Int Ed Engl. Feb. 17, 2003;42(7):768-72.

Stein V, Sielaff I, Johnsson K, Hollfelder F. A covalent chemical genotype-phenotype linkage for in vitro protein evolution. Chembiochem. Dec. 17, 2007;8(18):2191-4.

Tabuchi I, Soramoto S, Nemoto N, Husimi Y. An in vitro DNA virus for in vitro protein evolution. FEBS Lett. Nov. 23, 2001;508(3):309-12.

Takahashi F, Ebihara T, Mie M, Yanagida Y, Endo Y, Kobatake E, Aizawa M. Ribosome display for selection of active dihydrofolate reductase mutants using immobilized methotrexate on agarose beads. FEBS Lett. Mar. 6, 2002;514(1):106-10.

Tawfik DS, Griffiths AD. Man-made cell-like compartments for molecular evolution. Nat Biotechnol. Jul. 1998;16(7):652-6.

Thorsen T, Roberts RW, Arnold FH, Quake SR. Dynamic pattern formation in a vesicle-generating microfluidic device. Phys Rev Lett. Apr. 30, 2001;86(18):4163-6.

Vichier-Guerre S, Ferris S, Auberger N, Mahiddine K, Jestin JL. A population of thermostable reverse transcriptases evolved from *Thermus aquaticus* DNA polymerase I by phage display. Angew Chem Int Ed Engl. Sep. 18, 2006;45(37):6133-7.

Yonezawa M, Doi N, Kawahashi Y, Higashinakagawa T, Yanagawa H. DNA display for in vitro selection of diverse peptide libraries. Nucleic Acids Res. Oct. 1, 2003;31(19):e118.

Partial European Search Report, European Application No. 13167553.0 (Aug. 2, 2013).

The State Intellectual Property Office of China, 3rd Notification of Office Action, Chinese Application No. 200980121472.X (Jul. 22, 2013), 12 pages.

The State Intellectual Property Office of China, Search Report, Chinese Application No. 200980121472.X (Jul. 1, 2013), 5 pages.

NCBI Reference Sequence NP_057933.2, Pr180 [Moloney murine leukemia virus], 2 pages (Sep. 28, 2010), pp. 1-2.

Skirgaila, R. et al., "Compartmentalization of destabilized enzyme-mRNA-ribosome complexes generated by ribosome display: a novel tool for the directed evolution of enzymes," Protein Engineering, Design & Selection, vol. 26, No. 7, pp. 453-461 (2013).

Baranauskas, A. et al., "Generation and characterization of new highly thermostable and processive M-MuLV reverse transcriptase variants," Protein Engineering, Design & Selection, vol. 25, No. 10, pp. 657-668 (2012).

* cited by examiner

PRODUCTION OF NUCLEIC ACID

This application is a Continuation of U.S. patent application Ser. No. 12/899,641, filed on Oct. 10, 2010, and PCT/EP2009/054329 filed Apr. 9, 2009, the disclosures of each incorporated by reference in its entirety.

FIELD OF INVENTION

The present invention relates to a process for the production of nucleic acid encoding a target protein and target protein obtainable thereby, including enzymes such as nucleic acid processing enzymes, and in particular reverse transcriptase.

BACKGROUND OF THE INVENTION

Protein evolution is a known technology for selection and directed evolution of proteins from large libraries. The basic principle of selection is to ensure that there is a linkage between a specific phenotype (protein) and its encoding, genotype. This phenotype-genotype linkage can be realized in three different ways:
- covalent linkage such as mRNA display, and to some extent phage display, bacterial display, yeast display etc.,
- non-covalent linkage which use affinity interaction. Examples are ribosome display, CIS display, plasmid display etc.,
- compartmentalization such as in vitro compartmentalisation (IVC), compartmentalized self-replication (CSR), simple bacterial screening, high throughput screening etc.

As indicated in the above paragraph, one example of covalent phenotype-genotype linkage is achieved using mRNA display. As described by Roberts and Szostak (1997) covalent fusions between an mRNA and the peptide or protein that it encodes can be generated by in vitro translation of synthetic mRNAs that carry puromycin, a peptidyl acceptor antibiotic, at their 3' end.

Non-covalent linkage between phenotype and genotype can be achieved with ribosome display. In ribosome display, an array of RNAs including one or more encoding a target protein is subjected to an in vitro translation system so as to form a non-covalent ternary complex of ribosome, mRNA and protein coupled to tRNA. This array of ternary complexes must be stabilized. Accordingly, each ternary complex formed during in vitro translation uses mRNA lacking a STOP codon at the end. The ternary complexes are further stabilized at low temperature (4° C.) and high concentration of magnesium (50 mM). In the stable complex the linkage between phenotype and genotype is preserved. A selection step follows whereby target protein is selected on the basis of a property of the protein whilst still attached to the ternary complex. Selected ternary complexes may then be disassembled and the mRNA associated with the target protein is amplified by RT-PCR.

In general, ribosome display is successfully applied for the selection of peptides (Mattheakis et al., 1994; Matsuura and Pluckthun, 2003) and proteins (Hanes and Pluckthun, 1997; He and Taussig, 1997; Irving et al., 2001), which bind to different targets. In some cases it is possible to use ribosome display to select for enzymatic activities, performing affinity selection of proteins with suicide inhibitor (Amstutz et al., 2002) or active site ligand (Takahashi et al., 2002).

In in vitro compartmentalization (IVC) phenotype and genotype linkage is realized by in vitro compartmentalization of genes in a water-in-oil emulsion. The number of genes used to prepare the emulsion is calculated such that most of water compartments contain no more than a single gene. The compartmentalized genes are transcribed and translated. The activity of the synthesized proteins is then assessed. Subsequent selection on the basis of protein activity results in amplification of DNA encoding active proteins with desired properties. Water droplets used in most IVC applications are 2-3 µm in size, giving ~5 femtoliters reaction volume and ~$10^{10}$ water-in-oil compartments (50 µl water phase) per 1 ml of emulsion. The first successful example of IVC selection system was based on target-specific DNA methylation activity (Tawfik and Griffiths, 1998). Genes of HaeIII methyltransferase were compartmentalized, transcribed and translated. In vitro synthesized methyltransferase in the presence of a cofactor was able to methylate its own DNA. Based on methylated DNA (reaction product) resistance to digestion with HaeIII restriction endonuclease, genes encoding methyltransferase were selected from a $10^7$ fold excess of other DNA molecules.

To date many more modifications of IVC have been designed and realized. The easiest way to perform IVC selection is to use DNA-modifying enzymes, in particular DNA-methyltransferases (Lee et al., 2002; Cohen et al., 2004). A similar experimental strategy was applied in order to select for active variants of FokI restriction endonuclease (Doi et al., 2004). Compartmentalized DNA, encoding active restriction endonucleases, was digested and selected by subsequent incorporation of biotin-dUTP and binding to streptavidin beads.

A different IVC selection strategy was applied for evolution of DNA polymerases (Ghadessy et al., 2001; Ghadessy et al., 2004; Ong et al., 2006). This new selection method is based on 'compartmentalized self-replication' (CSR) of genes encoding active DNA polymerase. Contrary to usual IVC, where proteins of interest are expressed in situ, CSR is performed by compartmentalization of bacterial cells expressing thermophilic DNA polymerase. Cells resuspended in PCR buffer, supplemented with primers and dNTP's, are emulsified yielding compartments ~15 µm in size. Each water droplet serves as a separate PCR compartment. During the initial PCR denaturation step the bacterial cells are broken releasing the expressed thermophilic DNA polymerase and its encoding gene into the reaction mixture, allowing self-replication to proceed meanwhile other bacterial proteins are denatured by high temperature.

A modification of IVC is the use of double water-in-oil-in-water emulsions. Water droplets surrounded by an oil layer can be analyzed and sorted in a FACS at a rate of >$10^4$ variants per second (Bernath et al., 2004; Mastrobattista et al., 2005).

Selection of proteins for binding may also be performed by IVC. A protein of interest expressed in water-in-oil compartments is coupled covalently (Bertschinger and Neri, 2004) or non-covalently (Doi and Yanagawa, 1999; Yonezawa et al., 2003; Sepp and Choo, 2005) to the gene that encodes it.

Other applications of IVC are known where microbeads entrapped into compartments are used as intermediators for protein and gene coupling. Single genes attached to microbeads are transcribed and translated in water droplets. Newly synthesized protein is captured onto the same bead within reaction compartment. After emulsion is broken isolated beads can be used further for affinity selection (Sepp et al., 2002). Emulsions usually are broken using organic solvents (hexane, ether, chloroform), which can also decrease activity of certain enzymes displayed on the beads, limiting the application of this technology. For selection of catalytic activity microbeads can be easily washed, resuspended in different reaction buffer and compartmentalized again by second emulsification step (Griffiths and Tawfik, 2003). However sometimes rigid enzyme-bead-gene complexes (because of sterical hindrance and enzyme mobility limitations) can not fulfil essential reaction requirements and the activity of the attached enzymes may be lower than that of the free enzyme. In addition, such methods are technically complicated since many additional components have to be used (i.e. affinity tags, antibodies, and beads).

The composition of emulsions used in IVC is designed to ensure stability of water compartments and efficient in vitro transcription of mRNA and subsequent translation of target proteins. In vitro evolution has a broad range of targets to be improved. Some proteins and enzymes of interest are robust hard-workers and can be active enough in different buffers, in particular in reaction mixtures used in IVC. However there are many complicated enzymes, which can work only under optimized or specific conditions. In addition to that the first law of in vitro evolution says—"you will evolve what you are selecting for". That means, an enzyme evolved and optimized in transcription/translation reaction mixture will work well in that particular mixture and most likely will perform much worse in its own buffer. In some cases enzyme working conditions are incompatible with in vitro transcription and translation mixture used for protein expression in compartments. A partial solution is a nano-droplets delivery system (Bernath et al., 2005) used to transport different solutes into emulsion compartments. Even more sophisticated manipulations with water-in-oil compartments can be done employing microfluidics devices. Highly monodisperse single or double emulsions (Thorsen et al., 2001; Okushima et al., 2004) can be prepared at a rate of up to 10000 aqueous droplets per second. Generated water compartments can be transported in microfluidic channels, fused, subdivided and sorted (Song et al., 2003; Link et al., 2006). Nevertheless full buffer exchange in the compartments is still a problem.

Reverse transcriptases are very important commercial enzymes used to synthesize cDNA from an mRNA target. A lot of research has been done in order to improve properties of reverse transcriptases. However no properly working selection system suitable for in vitro evolution of reverse transcriptase was known to date. Almost all improvements are made and mutants of reverse transcriptase selected using high throughput screening and rational design.

Neither ribosome display (RD), nor in vitro compartmentalization (IVC) may be used for selection of fully active reverse transcriptase. Ternary complexes used in ribosome display usually are not stable at higher temperatures required to perform reverse transcriptase selection and as a consequence linkage between phenotype and genotype will be lost. Whilst relatively stable ternary complexes used in ribosome display can be produced using synthetic in vitro translation extract WakoPURE (Matsuura et al., 2007), in vitro translated reverse transcriptase immobilized to ribosome and mRNA will encounter significant steric hindrance during synthesis of full-length cDNA. There is also the possibility that immobilized enzyme will act in trans as well as in cis, which again is incompatible with protein evolution strategy, because the phenotype-genotype linkage will not be preserved.

IVC generally employs DNA as genetic material. In vitro transcription of mRNA and target protein translation is performed in spatially separated emulsified water compartments in the presence of the DNA. In the case of reverse transcriptase in vitro evolution, the presence of coding DNA sequence abolishes the main prerequisite of selection for reverse transcriptase activity—cDNA has to be synthesized de novo. In other words, selection for better reverse transcriptase variants is based on enzyme ability to synthesize their own coding cDNA from mRNA. Newly synthesized cDNA has to be amplified by PCR, therefore cDNA should be the only source of DNA in the reaction. DNA used in IVC selection will amplify together with cDNA canceling basic selection scheme.

More sophisticated variants of in vitro compartmentalization, such as usage of microbeads entrapped in water compartments (Sepp et al., 2002; Griffiths and Tawfik, 2003), allow complete exchange of reaction buffer. In this approach the phenotype-genotype linkage is realized via microbeads yielding a rigid selection unit mRNA-microbead-protein, which, in case of reverse transcriptase selection, again can cause steric hindrance and as a result inefficient cDNA synthesis.

Taq DNA polymerase able to synthesize ~300 nucleotides long cDNA was selected using modification of phage display technology (Vichier-Guerre et. al, 2006). Although this approach works, it has some shortcomings: 1) not all proteins can be displayed on phages; 2) absolute requirement to use biotin labeled nucleotides for selection; 3) displayed enzyme can work in trans as well as in cis; 4) because of steric hindrance and enzyme mobility limitations phage-enzyme-DNA/RNA complex can interfere with efficient synthesis of cDNA.

The possibility of selection for reverse transcriptase is also mentioned in WO0222869, which is related to the compartmentalized self-replication (CSR) method. CSR technology is used to select thermophilic DNA polymerases, in particular Taq DNA polymerase (Ghadessy et al., 2001; Ghadessy et al., 2004; Ong et al., 2006). Bacterial cells, expressing mutants library of thermophilic DNA polymerase are suspended in PCR mixture and emulsified yielding separate PCR compartments for in vitro selection of more active polymerases.

Real selection for reverse transcriptase activity will be prevented by the presence of bacterial RNases, which remain active at moderate temperatures and will degrade target mRNA. There will also be DNA contamination from non-selected plasmid DNA (released from bacterial cell) as well as the presence of all *E. coli* enzymes, structural proteins, ribosomes, NTP, RNases, DNases and small molecular weight molecules.

SUMMARY OF THE INVENTION

The present invention aims to provide an improved method of protein evolution which does not suffer from drawbacks of the prior art methods.

Accordingly, in a first aspect, the present invention provides a process for the production of nucleic acid encoding a target protein, which comprises:
  (a) providing an array of RNA or DNA molecules including one or more encoding the target protein;
  (b) generating a target protein from the array to form RNA-protein or DNA-protein complexes in which the RNA or DNA molecule is non-covalently or covalently bound to the complex;
  (c) separating the complexes into compartments wherein most or all of the compartments contain no more than one complex;
  (d) subjecting the complexes to reaction conditions which allow target protein activity; and
  (e) selecting nucleic acid encoding the target protein on the basis of the activity associated therewith,
wherein when the complex is a DNA-protein complex in which the DNA is non-covalently bound, step b) is performed in the absence of separate compartments for each complex.

The present inventors have devised a method which utilizes two distinct types of phenotype-genotype linkage and achieves a new selection system for use in methods of protein evolution within the laboratory.

The new features of the method, described further below, allow it to be applied to an extended range of target proteins in comparison to the methods of the prior art, with increased ease of use and flexibility. In particular, the present invention provides for the first time the possibility of evolving and improving the properties of reverse transcriptase enzymes— one of the most important enzyme groups in the toolbox of molecular biologists.

In one embodiment of this aspect the invention provides a process for the production of nucleic acid encoding a target protein, which comprises:
 (a) providing an array of RNA or DNA molecules including one or more encoding the target protein;
 (b) generating a target protein from the array to form RNA-protein or DNA-protein complexes;
 (c) separating the complexes into compartments wherein most or all of the compartments contain no more than one complex;
 (d) subjecting the complexes to reaction conditions which allow target protein activity; and
 (e) selecting nucleic acid encoding the target protein on the basis of the activity associated therewith,
wherein in the RNA-protein complex the RNA is non-covalently or covalently bound thereto and in the DNA-protein complex the DNA is covalently bound thereto.

In a second embodiment of this aspect the invention provides process for the production of nucleic acid encoding a target protein, which comprises:
 (a) providing an array of RNA or DNA molecules including one or more encoding the target protein;
 (b) generating a target protein from the array to form RNA-protein or DNA-protein complexes in which the RNA or DNA molecule is non-covalently or covalently bound to the complex;
 (c) separating the complexes into compartments wherein most or all of the compartments contain no more than one complex;
 (d) subjecting the complexes to reaction conditions which allow target protein activity; and
 (e) selecting nucleic acid encoding the target protein on the basis of the activity associated therewith,
wherein step b) is performed in the absence of separate compartments for each complex.

Covalent linkages between DNA or RNA and the target protein can be generated by any technique known in the art, for example, mRNA display, phage display, bacterial display or yeast display. In particular, a covalent RNA-protein linkage can be generated using the technique of mRNA display, while a covalent DNA-protein linkage can be generated using the technique of covalent antibody display (CAD) (Reiersen et al., 2005), performing translation in compartments by covalent DNA display (Bertschinger and Neri, 2004), or using similar covalent display techniques such as those described by Stein et al., (2005).

Non-covalent linkages between DNA or RNA and the target protein can also be generated by any technique known in the art, for example, ribosome display, CIS display, or plasmid display. In particular, a non-covalent DNA-protein linkage can be generated in the absence of a compartment using CIS display (Odergrip et al., 2004), while a non-covalent RNA-protein linkage can be generated using the technique of ribosome display.

As indicated above, when the complex is a DNA-protein complex in which the DNA is non-covalently bound, step (b) of the process of the invention is performed in the absence of separate compartments for each complex. In other words, step (b) is un-compartmentalised. Specifically, when the complex generated is a DNA-protein complex in which the DNA is non-covalently bound, the generation step is performed without separating each member of the array from one another. In particular, the generation step is performed without separating each member of the array by in vitro compartmentalization (IVC). In a particularly preferred embodiment the generation step is performed without separating each member of the array in a water-in-oil emulsion.

Compartmentalisation can also be performed by any method known in the art which enables the complexes to be generated or separated such that all or substantially all of the compartments contain no more than one complex. In particular, it is preferred. that at least 70%, at least 80% or at least 90% of the compartments contain no more than one complex. For example, compartmentalization can be performed by separating members of the array or each complex into different wells on a microtitre or nanotitre plate, or by in vitro compartmentalization (IVC). In particularly, separation by IVC can involve separation into aqueous droplets in a water-in-oil emulsion or a water-in-oil-in-water emulsion.

The method of the present invention combines at least two different types of genotype-phenotype linkage selected from the list covalent linkage, non-covalent linkage and compartmentalization. In a preferred aspect of the invention the method utilized no more than two of these linkages. Thus in a particularly preferred embodiment the method utilizes the covalent or non-covalent linkage as the only genotype-phenotype linkage in step b). In other words, in this embodiment there is no compartmentalization in step b).

Covalent/non-covalent linkages between DNA or RNA and the protein in the absence of a compartment can be established in many different ways, for example, by ribosome display, mRNA display (Roberts and Szostak, 1997), CIS display (Odergrip et al., 2004) or covalent antibody display (CAD) (Reiersen et al., 2005). Specifically, covalent DNA-protein linkage can be realized in the absence of compartments by using CAD technique, while covalent RNA-protein linkage and non-covalent RNA-protein linkage can be established by mRNA display and ribosome display, respectively.

The present invention can be realized through a combination of many different linkages. For example, the present invention can be realized through a combination of ribosome display and in vitro compartmentalization, or through a combination of mRNA display, CIS display, or CAD display and IVC.

In a preferred aspect the process for the production of nucleic acid encoding a target protein is realized through a combination of ribosome display and in vitro compartmentalization. In particular such an process comprises:
 (a) providing an array of mRNAs including one or more encoding the target protein;
 (b) incubating the array of mRNAs under conditions for ribosome translation to generate an array of ternary complexes each comprising an mRNA, a ribosome and protein translated from the mRNA;
 (c) incorporating the array of ternary complexes into aqueous phase droplets of a water-in-oil or a water-in-oil-in-water emulsion, wherein most or all of the aqueous phase droplets contain no more than one ternary complex;
 (d) subjecting the aqueous phase droplets to reaction conditions which allow protein activity; and (e) selecting nucleic acid encoding the target protein on the basis of the enzyme activity associated therewith.

Such a process according to the present invention may be termed "compartmentalized ribosome display" (CRD). CRD is applicable to a wide range of target proteins, including enzymes. CRD has the advantage that the linkage between the enzyme and the mRNA is non-covalent. Thus if the reaction conditions used in step (d) involve a raised temperature the ternary complexes generated in step (b) will fall apart and the enzyme will be released. This avoids the problems associated with enzyme mobility described above for prior art methods in which the enzyme is immobilized on a bead.

Emulsion droplets with ribosome display complexes inside can be sorted or selected in step (e) in many ways. Preferably they are sorted by fluorescence activated cell sorting (FACS) or using microfluidic techniques. Both techniques mainly exploit fluorescence based droplet sorting. However, droplets can also be separated by size, light diffraction or light absorption, depending on the reaction conditions used in step (d) and the protein activity that is being selected for.

Fluorescent based sorting methods are preferably used when the target protein is an enzyme. In this embodiment the reaction conditions employed in step (d) include a non-fluorescent substrate capable of being converted to a fluorescent product. Activity by the enzyme generates the fluorescent product, allowing FACs to be used to distinguish between fluorescent droplets containing an active enzyme and non- or less fluorescent droplets which contain no active enzyme or a less active enzyme.

In particular, CRD is applicable to nucleic acid processing enzymes such as reverse transcriptases, and allows for fast and efficient in vitro evolution.

In a further aspect the present invention provides a process for the production of nucleic acid encoding a target protein, which comprises:
   (a) providing an array of mRNAs including one or more encoding the target protein, wherein the mRNAs comprise a substrate for an enzyme comprising the target protein or a co-enzyme thereof;
   (b) incubating the array of mRNAs under conditions for ribosome translation to generate an array of ternary complexes each comprising an mRNA, a ribosome and protein translated from the mRNA;
   (c) incorporating the array of ternary complexes, and optionally the co-enzyme, into aqueous phase droplets of a water-in-oil or a water-in-oil-in-water emulsion, wherein most or all of the aqueous phase droplets contain no more than one ternary complex;
   (d) subjecting the aqueous phase droplets to reaction conditions which allow enzyme activity; and
   (e) selecting nucleic acid encoding the target protein on the basis of the enzyme activity associated therewith.

In one embodiment of this aspect of the invention, where the nucleic acid processing enzyme is a DNA dependent DNA polymerase, the mRNA of step (a) can be ligated to a double stranded DNA adaptor molecule to provide the substrate.

CRD diversity is $\sim 10^9$-$10^{10}$ variants and is limited by IVC step. The new method is much more efficient, less time consuming and cheaper compared to high throughput screening (HTS), which can be used to screen $\sim 10^5$-$10^6$ mutant variants of reverse transcriptase. CRD diversity is about four orders of magnitude higher compared to HTS; thus many more beneficial mutants missed by HTS can be easily fished-out by compartmentalized ribosome display selection.

According to step (a), an array of mRNAs which are typically synthesized mRNAs is provided which includes one or more members of the array encoding the target protein.

Where the target protein is reverse transcriptase the mRNAs comprise a substrate for an enzyme comprising the target protein or a co-enzyme thereof. In the subsequent selection step (e), the nucleic acid encoding the target protein is selected on the basis of the enzyme activity associated therewith. In this way, two embodiments of the invention are contemplated: one in which the enzyme activity is provided by the target protein and one in which the enzyme activity is provided by a co-enzyme of the target protein in the presence of the target protein. In the embodiment requiring the co-enzyme, this is incorporated into aqueous phase droplets of the water-in-oil emulsion of step (c), as is the array of ternary complexes. Where the enzyme comprises the target protein, no additional co-enzyme need to be incorporated into the aqueous phase droplets.

In step (b) of the process, the array of mRNAs is treated with ribosomes to generate an array of ternary complexes, each comprising an mRNA, a ribosome and protein translated from the mRNA. This step may be performed under any conditions suitable for typical in vitro translation of mRNA, as used for example in the technique of ribosome display. At this point, the ternary complexes may be purified, although this is not essential. The ternary complexes may be supplemented at this point with any co-substrates necessary for the subsequent enzyme activity whereupon the reaction mixture is typically emulsified to give approximately $10^{10}$ water-in-oil compartments each typically having a mean diameter of approximately 2 to 3 µm. Even a small volume (25 µl) of in vitro translation reaction generates approximately $10^{11}$ to $10^{12}$ molecules of stored ribosomal complexes. A typical ribosome display method uses mRNAs lacking STOP codons, although STOP codon may be present (Matsuura et al., 2007). In order to achieve aqueous phase droplets in which most or all contain no more than one ternary complex the concentration of ternary complexes would have to be reduced by about two orders of magnitude as compared with corresponding concentration used in a typical ribosome display technique. Only a very small concentration of ternary complexes is used in this step of the process.

The enzyme may comprise a nucleic acid processing enzyme, which may be an RNA processing enzyme. The nucleic acid processing enzyme may comprise the target protein and may be selected from a nucleic acid polymerase, a nucleic acid ligase and a terminal deoxynucleotidyl transferase. As described in further detail herein, the nucleic acid polymerase may comprise a reverse transcriptase. In this embodiment, the mRNA encoding the reverse transcriptase is itself the substrate for the reverse transcriptase. Step (e) of selecting nucleic acid encoding the target protein, comprises selecting cDNA produced by the action of the reverse transcriptase, which cDNA encodes reverse transcriptase.

Where the target protein is a nucleic acid ligase, selection for RNA (DNA) ligases able to ligate RNA to RNA or DNA to RNA can be performed. Preferably, the reaction conditions which allow enzyme activity include a co-substrate comprising a nucleic acid linker or adaptor, which co-substrate further comprises an affinity ligand for attachment to a ligand binding partner or sequence tag for specific amplification of processed mRNA in RT-PCR. In the first case, the mRNA encoding the target protein is ligated to the co-substrate in those aqueous phase droplets which incorporate mRNA encoding a nucleic acid ligase. Preferably, the affinity ligand comprises biotin and the ligand binding partner comprises streptavidin. The step of selecting nucleic acid encoding the target protein comprises selecting mRNA incorporating the co-substrate by attachment to a solid phase comprising the ligand binding partner. In a typical process, a mutant library of ligase is translated in vitro and purified ternary complexes are diluted and emulsified in reaction buffer with biotin labeled DNA/RNA linker and/or adaptor. After bringing the emulsion to a temperature of 37° C. ribosome ternary complexes disassemble. Ligase will be released and the 3' end of the mRNA will become accessible for the biotin labeled adaptor and subsequent ligation reaction. Biotin labeled mRNA encoding only active (or more active) variants of ligase will be purified on the streptavidin beads and may be amplified by RT-PCR.

In the second case the step of selecting nucleic acid encoding the target protein comprises selecting mRNA with attached sequence specific tag, which can be used for selective annealing site of primer for reverse transcription and subsequent PCR.

In a typical process, a mutant library of ligase is. translated in vitro and purified ternary complexes are diluted and emulsified in reaction buffer with DNA/RNA linker and/or adaptor. After bringing the emulsion to a temperature of 37° C. ribosome ternary complexes disassemble. Ligase will be released and the 3' end of the mRNA will become accessible for the adaptor and subsequent ligation reaction. RNA encoding only active (or more active) variants of ligase will have specific linker sequence required for specific annealing of primer used in reverse transcription and may be efficiently amplified by RT-PCR.

It is also possible to select for terminal deoxynucleotidyl transferase (TdT). This enzyme works on RNA and incorporates deoxyribonucleotides, ribonucleotides, nucleotide analogues and similar. In this embodiment, the reaction conditions which allow enzyme activity include a co-substrate comprising dNTP which further comprises an affinity ligand for attachment to a ligand binding partner. As with the nucleic acid ligase, the affinity ligand may be biotin and the ligand binding partner streptavidin. Selecting nucleic acid encoding the target protein may comprise selecting mRNA incorporating the co-substrate by attachment to a solid phase comprising the ligand binding partner. A mutant library of TdTs may be translated in vitro and purified ribosome ternary complexes may have to be diluted and emulsified in reaction buffer with biotin labeled nucleotides, such as biotin-dUTP. The optimal working temperature for wild type enzyme is 37° C. At this temperature the ribosome ternary complexes will disassemble and the 3' end of mRNA will become accessible for template independent polymerization reaction. TdT-encoding mRNA incorporating biotin labeled nucleotide is selected on the streptavidin beads and may subsequently be reversed transcribed and amplified by RT-PCR.

In a further embodiment, the target protein comprises a reverse transcriptase helper enzyme such as a helicase, pyrophosphatase, processivity factor, RNA binding protein or other protein able to improve a reverse transcription reaction in the presence of reverse transcriptase. In this embodiment, the nucleic acid processing enzyme comprises a reverse transcriptase, which is the co-enzyme incorporated into the aqueous phase droplets of the water-in-oil emulsion. In step (e) of selecting nucleic acid target protein; cDNA is selected, which cDNA is produced by the action of the reverse transcriptase and which encodes the reverse transcriptase helper enzyme. The presence of the reverse transcriptase helper enzyme in the aqueous phase facilitates reverse transcription of the mRNA which encodes the helper. Thus, mRNA which is reverse transcribed forms cDNA which encodes the helper and this may be PCR amplified.

In a further embodiment, the target protein comprises an RNase inhibitor. In this embodiment, the nucleic acid processing enzyme comprises an RNase. The step (e) of selecting nucleic acid encoding the target protein comprises selecting mRNA undegraded by RNase. In this embodiment, the RNase is incorporated as the co-enzyme into the aqueous phase droplets of the water-in-oil emulsion. Once reaction conditions allow enzyme activity, any droplets not containing effective RNase inhibitor would exhibit RNase activity whereby the mRNA would be degraded. Thus, mRNA encoding RNase inhibitor effective at the reaction conditions used would survive. Typically, a mutant library of RNase inhibitors is translated in vitro and purified ribosome ternary complexes are diluted and emulsified in reaction buffer with appropriate RNase. In an alternative arrangement RNase can be delivered later by emulsion micro droplets. mRNA encoding only active (or more stable) RNase inhibitor will be purified and amplified by RT-PCR.

Compartmentalized ribosome display can also be used for reaction buffer exchange in in vitro compartmentalization where selection buffer is incompatible with in vitro translation mixture and substrate conversion to product has to be performed under strictly controlled reaction conditions.

The nucleic acid encoding the target protein which has been selected on the basis of the enzyme activity associated therewith may be DNA or RNA, as discussed herein. The array may be converted or amplified to form DNA or RNA. In a preferred arrangement, the array is converted or amplified to form the array of mRNAs of step (a) of the process and is subject to one or more further cycles of steps (b) to (e) so as to enrich further the array with increasing amounts of mRNAs encoding the target protein.

The step (d) of subjecting the aqueous phase droplets to reaction conditions which allow enzyme activity provides the basis for selection step (e) where those nucleic acids encoding the target protein are selected. A wide range of reaction conditions may be used in step (d) to provide selection pressure. In one example, the reaction conditions include a temperature above the optimum temperature for a wild type enzyme. These reaction conditions may be used to select a mutant enzyme which is more thermostable than wild type enzyme or which has a greater reaction velocity at that temperature or an altered temperature-activity profile. Mutant enzymes may have to operate at higher sensitivities than wild type enzymes because concentrations of mRNA in the aqueous phase droplets are approximately 400 pM. Mutant enzymes may also have to perform more accurately. All of these selection pressures are particularly important in relation to reverse transcriptases. As well as physical conditions, the reaction conditions may include alterations in buffer, concentrations of other factors such as metal ions and pH.

Many more different selection pressures can be applied in CRD selecting for better reverse transcriptases: 1) selection for more soluble enzymes which are less prone to aggregation—ternary complexes (before emulsification) have to be preincubated with hydrophobic material in order to eliminate proteins with surface exposed hydrophobic residues; 2) selection for very fast enzymes—reverse transcription reaction times have to be gradually reduced during selection cycles; 3) selection for enzymes synthesizing long cDNA—gradual prolongation of mRNA library used in CRD and as a consequence synthesis of longer cDNA; 4) selection for enzymes able to transcribe through secondary structures—secondary structure forming sequences have to be introduced into mRNA library used in CRD; 5) selection for enzymes working in buffers which are different from RT buffer (for example in PCR, one step RT-PCR buffer or with denaturing agents)—CRD selection has to be performed in buffer of our choice; 6) selection for enzymes able to incorporate nucleotide analogues—selection has to be performed in RT buffer with biotin labeled nucleotide analogues with subsequent cDNA purification on streptavidin beads.

Figure 10:
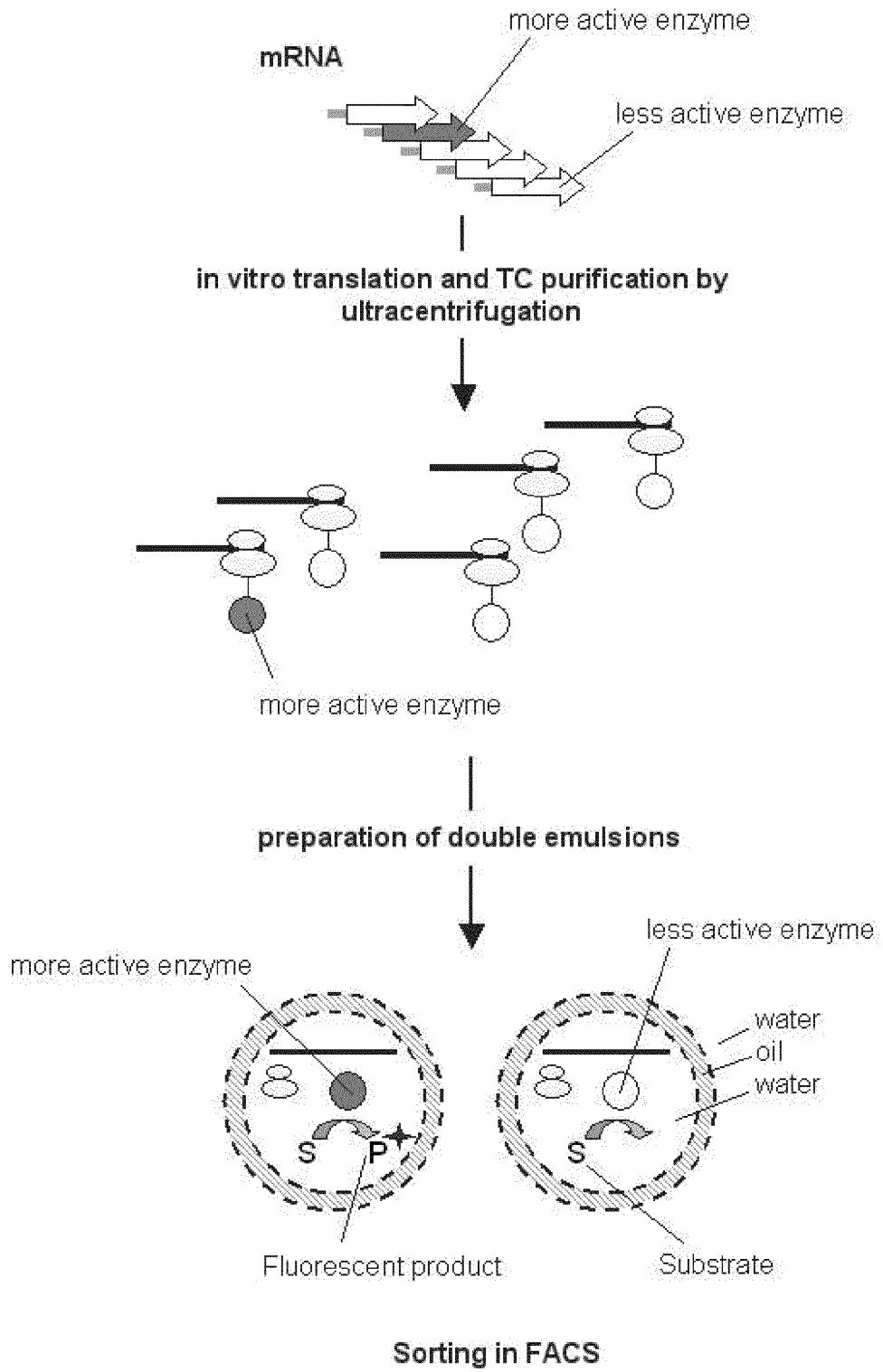

Compartmentalized ribosome display (CRD) is also suitable for many fluorescence activated cell sorting (FACS) applications. Protein of interest has to be displayed in ribosome display format. Optionally purified (or just diluted many times) ternary complex comprising mRNA-ribosome-protein (tRNA) mixed with non fluorescent substrate (S) in reaction buffer should be emulsified producing double water-in-oil-in-water emulsions (Bernath et al., 2004; Mastrobattista et al., 2005). Active variants of compartmentalized enzymes will convert substrate (S) to fluorescent product (P) allowing FACS to distinguish between fluorescent (active enzyme inside) and "dark" (inactive enzyme inside) droplets. Contrary to previously published examples, where enzymatic reaction has to be performed in transcription/translation mixture, CRD allows for complete buffer exchange and selection for active enzymes in more native (required) conditions (FIG. 10.)

Figure 11:
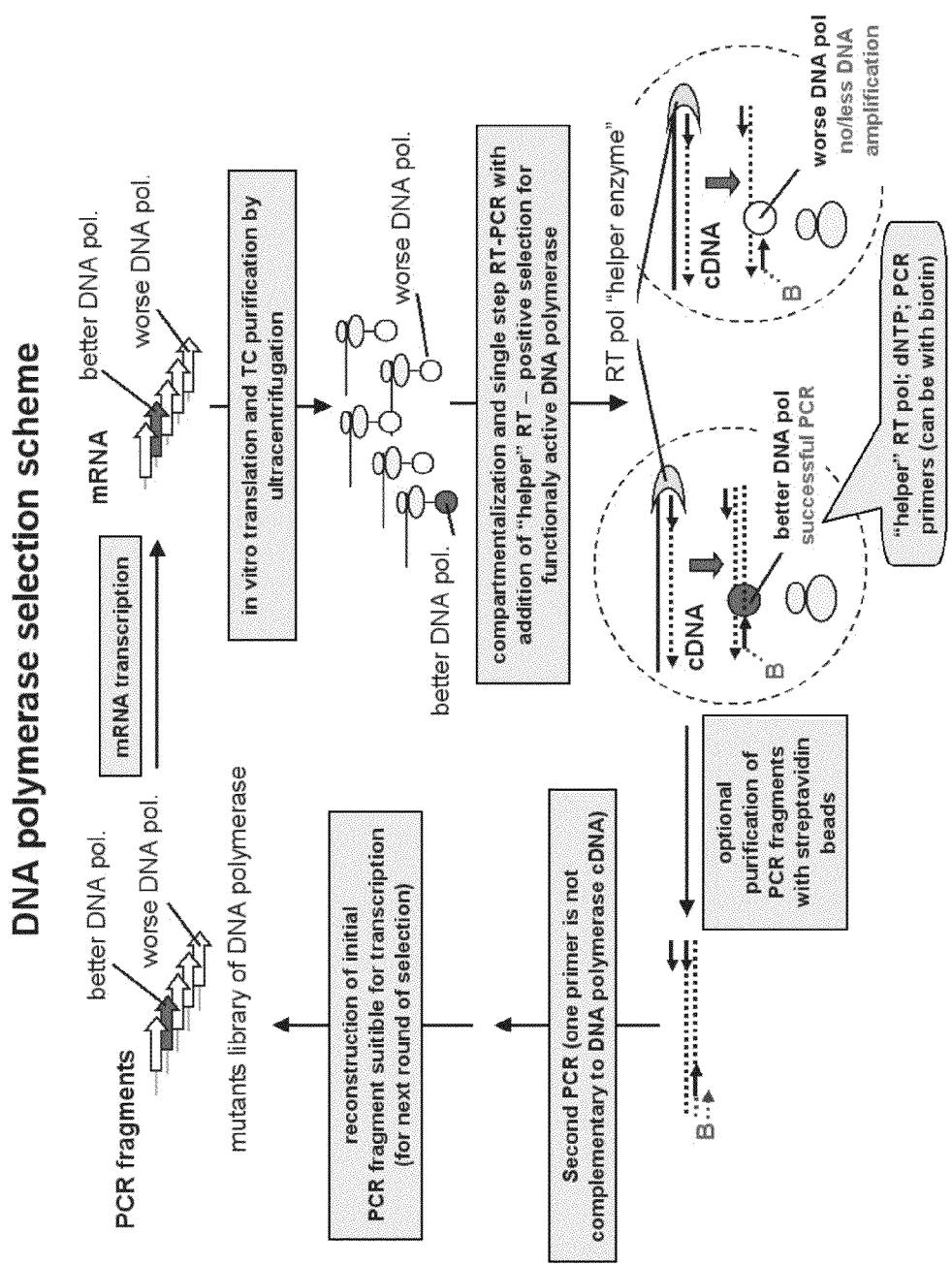

Selection and evolution of thermostable DNA polymerases using CRD is also possible (FIG. 11.). Polymerase of interest has to be displayed in ribosome display format. Optionally purified (or just diluted many times) ternary complex comprising mRNA-ribosome-polymerase can be used to prepare reaction mixture with reverse transcriptase (helper enzyme), dNTP's and primer set in PCR buffer. Reaction solution should be emulsified producing water-in-oil emulsion. In first RT step—reverse transcriptase has to synthesize cDNA, which subsequently will serve as a target for second PCR step—cDNA amplification by ribosome displayed DNA polymerase. One of the primers used in PCR can have biotin for optional subsequent purification with streptavidin beads and non-complementary 5' end. After RT-PCR emulsions should be broken, newly synthesized DNA fragment can be purified via biotin and reamplified using new primer set, which will contain one primer with sequence non-complementary to cDNA, but identical to 5' part of primer used in first amplification reaction (selective amplification of DNA over cDNA background). More active variants of DNA polymerase will be enriched over less active variants and can be used for further analysis or next selection-round (FIG. 11.).

Important features of the compartmentalized ribosome display technology are:
1) the genotype is maintained by an mRNA library, which is especially useful in selecting RNA processing enzymes;
2) the selection unit is a ternary complex of mRNA-ribosome-protein (tRNA) and this can readily purified by ultracentrifugation, gel-filtration, affinity tag purification and other simple means;
3) the reaction buffer can be exchanged thereby enabling the selection unit to be transferred (with or without purification) to a new reaction mixture and at the same time be diluted by a factor of 100 to 200 (in order to adjust the number of ribosome complexes after emulsification to less than one molecule per reaction compartment);
4) the mRNA library diversity of CRD is limited only by the diversity of the in vitro compartmentalization and is less than $10^{10}$ different variants;
5) once emulsified, the selection reaction can be performed at a broad range of temperatures from 4° to 94° C. because emulsions are stable over these temperatures;
6) if selections performed at elevated temperatures (30° C. and above), the ternary complexes will dissociate but remain compartmentalized so as not to lose the genotype-phenotype link, releasing mRNA and in vitro translated protein.

The compartmentalized ribosome display process of the present invention has been found to work particularly well in promoting evolution of new reverse transcriptase enzymes. As an example, M-MuLV reverse transcriptase (Gerard et al., 1986, pRT601) may be used for selection (the enzyme including a N terminal His tag for purification). This reverse transcriptase has a temperature optimum for activity at 42° C. and is active at temperatures up to 50° C. An array of mRNAs encoding the M-MuLV reverse transcriptase may be subjected in step (d) of the process of the present invention to reaction conditions which include primer and dNTPs required for cDNA synthesis at an incubation temperature in the range of from 50° C. to 60° C. At these elevated temperatures stored ribosomal complexes stable at 4° C. quickly dissociate releasing into solution a reverse transcriptase substrate (mRNA) and enzyme.

In one embodiment, in vitro translated reverse transcriptase M-MuLV released from ribosomal complex has C terminal fusion with phage lambda outer surface protein D used in ribosome display construct as a spacer to remain in ribosomal tunnel (Matsuura and Pluckthun, 2003) and covalently bound tRNA, because translation was not terminated properly. Protein D is very well expressed, soluble, stable protein with unfolding transition temperature ~57° C. (Forrer and Jaussi, 1998) and therefore is good fusion partner for selection of thermostable reverse transcriptase.

In compartmentalized ribosome display selection method only fully active variants of reverse transcriptase can perform synthesis of cDNA, which encodes the same active enzyme. In 1 hr, after the reverse transcription reaction is completed, emulsion is broken, cDNA is purified and amplified by nested PCR. Because of the selection nature of CRD only cDNA, which encodes active variants of reverse transcriptase, able to perform full length cDNA synthesis, will be amplified and if necessary transferred to the next selection round. In order to eliminate undesirable mutations in T7 polymerase promoter region, ribosome binding site (RBS) and protein D sequence, amplified DNA, encoding only M-MuLV sequence, may be ligated to native 5' and 3' terminal fragments in such way that original ribosome display construct is restored and next selection round can be performed.

In five selection rounds enzyme variants with specific activities at 50° have been identified, which are 2-4 times better as compared to the activity of the primary enzyme used for library preparation. Some of proteins are faster, some—more thermostable. Many selected M-MuLV variants have mutations D524G or D583N, which turn off RNase H activity of reverse transcriptase and improve cDNA synthesis as well as thermostability (Gerard et al., 2002). Many more variants of selected M-MuLV reverse transcriptases have other different beneficial mutations (H204R; H638R; T197A; M289V; E302K; T306A; N454K; Y64C; E69G; Q190R; V223M; F309S; L435P; E562K) mentioned and described before (U.S. Pat. No. 7,056,716; US20060094050A1; U.S. Pat. No. 7,078,208; US20050232934A1; WO07022045A2). In addition to that we have found many new hot spots in reverse transcriptase amino acids sequence. Some mutations repeat very frequently and are of very high importance, what was shown analyzing purified mutants (Example 2). Thus we can state, that our CRD technology is very fast and robust selection method, efficiency of which was confirmed by direct evolution and improvement of M-MuLV reverse transcriptase. As proof of principle we have selected variants of M-MuLV reverse transcriptase working better at higher temperatures.

In a further aspect, the present invention provides a reverse transcriptase enzyme obtainable by the process as described herein.

In a further aspect, the present invention provides a reverse transcriptase enzyme having an optimum activity at a temperature above 42° C., preferably at least 50° C. and more preferably in the range of from 50° C. to 60° C. Reverse transcriptase enzymes may be selected according to the process described herein by applying reaction conditions having an elevated temperature, preferably of at least 50° C. In this aspect of the invention, a reverse transcriptase enzyme may be selected which has an activity-temperature profile which is shifted in comparison with wild type enzyme to increase the temperature at which optimum activity is observed.

In a further aspect, the invention provides a reverse transcriptase enzyme which comprises a MMLV reverse transcriptase amino acid sequence with a mutation at one or more of the following amino acid positions:

| D200, | D653, | L603, | T330, | L139, | Q221, |
|---|---|---|---|---|---|
| T287, | I49, | N479, | H594, | F625, | H126, |
| A502, | E607, | K658, | P130, | Q237, | N249, |
| A307, | Y344, | Q430, | D449, | A644, | N649, |
| L671, | E673, | M39, | Q91, | M66, | W388, |
| I179 | E302 | L333 | R390 | Q374 and | E5 |

Where the mutation is at D653 it is preferred that the mutation is not D653N. Where the mutation is at L603 it is preferred that the mutation is not L603A. Further, where the mutation is at H594 it is preferred that the mutation is not H594A.

It is preferred that the mutations at the above positions are point mutations.

Preferably, the reverse transcriptase has one or more of the following mutations:

| D200N, A or, G, | D653N, G, A, H or, V, | L603W or M, T330P, L139P, Q221R, | | | |
|---|---|---|---|---|---|
| T287A, | I49V or T, | N479D, | H594R or Q, | | F625S or L, |
| H126S or R, | | | | | |
| A502V, | E607K, G or A, | K658R or Q | P130S, | Q237R, | N249D, |
| A307V, | Y344H, | Q430R, | D449G or A, | | A644V or T, |
| N649S, | | | | | |
| L671P, | E673G or K, | M39V or L, | Q91R or L, | M66L, | W388R, |
| I179T or V | E302K | L333Q | R390W | Q374R and E5K | |

Each of these mutations is found, for example, in mutant enzymes having a higher activity at 50° C. as compared with the corresponding wild type enzyme. Further details of these mutations are described in the specific examples.

In particularly preferred aspect of the invention the mutant enzyme has at least two mutations. In one embodiment the two mutations are at D200 and at L603. For example the mutations are D200N and L603W. In an alternative embodiment the mutations are at N479 and H 594. For example the mutations are N479D and H594R.

In a further aspect, the invention provides a reverse transcriptase enzyme having an optimum activity at a temperature above 37° C., wherein the activity at 50° C. is at least 120% of the activity at 37° C. Preferably, the activity at 50° C. is at least 130%, more preferably at least 160% of the activity at 37° C.

In a further aspect, the present invention provides a mutant reverse transcriptase enzyme having an activity at 50° C. which is at least twice that of the corresponding wild type enzyme.

In a further aspect, the present invention provides a mutant reverse transcriptase enzyme having a specific activity at 37° C. which is at least 130% of the corresponding wild type enzyme. Preferably, the specific activity of the mutant reverse transcriptase enzyme is at least 140%, more preferably at least 150% and particularly preferably at least 160% of the specific activity of the corresponding wild type enzyme. It has been found as described herein that partially purified wild type enzyme specific activity at 37° C. is approximately 200000 U/mg. Specific mutant reverse transcriptase enzymes obtainable in accordance with the present invention are discussed in further detail in the specific examples.

In a further aspect, the present invention provides a mutant reverse transcriptase enzyme having a thermostability of at least 1.5 times that of the corresponding wild type enzyme. Thermostability is measured in the present application as residual activity at 37° C. following treatment at 50° C. for 5 minutes. Preferably, the thermostability of the mutant reverse transcriptase enzyme is at least 1.5 times, more preferably at least 2 times, still more preferably at least 2.5 times that of the corresponding wild type enzyme. Typically, residual activity at 37° C. of the wild type reverse transcriptase enzyme is approximately 11% as compared with untreated enzyme.

It is preferred that the reverse transcriptase enzyme according to the invention comprises an MMLV reverse transcriptase.

In a further aspect, the present invention provides a polynucleotide, such as an mRNA or DNA, encoding a reverse transcriptase as described herein.

The reverse transcriptases according to the present invention may be used in a variety of molecular biology techniques such as RT-PCR (qRT-PCR, etc). A kit for RT-PCR may be provided in which the reverse transcriptase of the kit is a reverse transcriptase according to the present invention.

DETAILED DESCRIPTION OF INVENTION

The invention will now be described in further detail, by way of example only, with reference to the accompanying figures and appendices:

FIG. 1. The experimental scheme of Example 1. Two plasmids pET_his_MLV_pD (encoding Moloney Murine Leukemia Virus (M-MLV) reverse transcriptase fused to protein D spacer) and pET_his_del_pD (encoding inactivated (57 amino acids deletion in pol domain) Moloney Murine Leukemia Virus (M-MLV) reverse transcriptase fused to protein D spacer) were used to synthesize PCR fragments. PCR fragments furtheron are used in transcription reaction and synthesis of mRNA lacking STOP codon at the 3' end. Purified mRNA is mixed with ratio 1:50=MLV (active RT):del (inactive RT) and used for in vitro translation reaction. During translation reaction ribosomal complex synthesizes protein and stops at the end of mRNA lacking STOP codon. Mixture of ternary complexes (TC) is purified by ultracentrifugation on sucrose cushions. Purified ternary complexes ($<3*10^9$ molecules taken) already containing mRNA linked to in vitro translated MLV reverse transcriptase are used to prepare reverse transcription reaction mix supplemented with external dNTP set and primer for RT reaction. Ice-cold RT reaction mixture is emulsified giving $\sim 1*10^{10}$ water in oil compartments $\sim 2$ μm in size. Emulsified RT reaction mixture (less than one TC (mRNA+MLV RT) per compartment is incubated for 1 hr at 42° C. in order to perform RT reaction. After the temperature of compartmentalized RT reaction mixture is raised most of TC dissociate releasing mRNA and reverse transcriptase. Successful RT reaction is performed only in compartments containing active MLV reverse transcriptase (MLV_pD) and no cDNA is synthesized in compartments with inactive reverse transcriptase (del_pD). Subsequent PCR amplifies cDNA and enrichment of active reverse transcriptase (MLV_pD) genes over inactive reverse transcriptase (del_pD) is observed.

Figure 2:
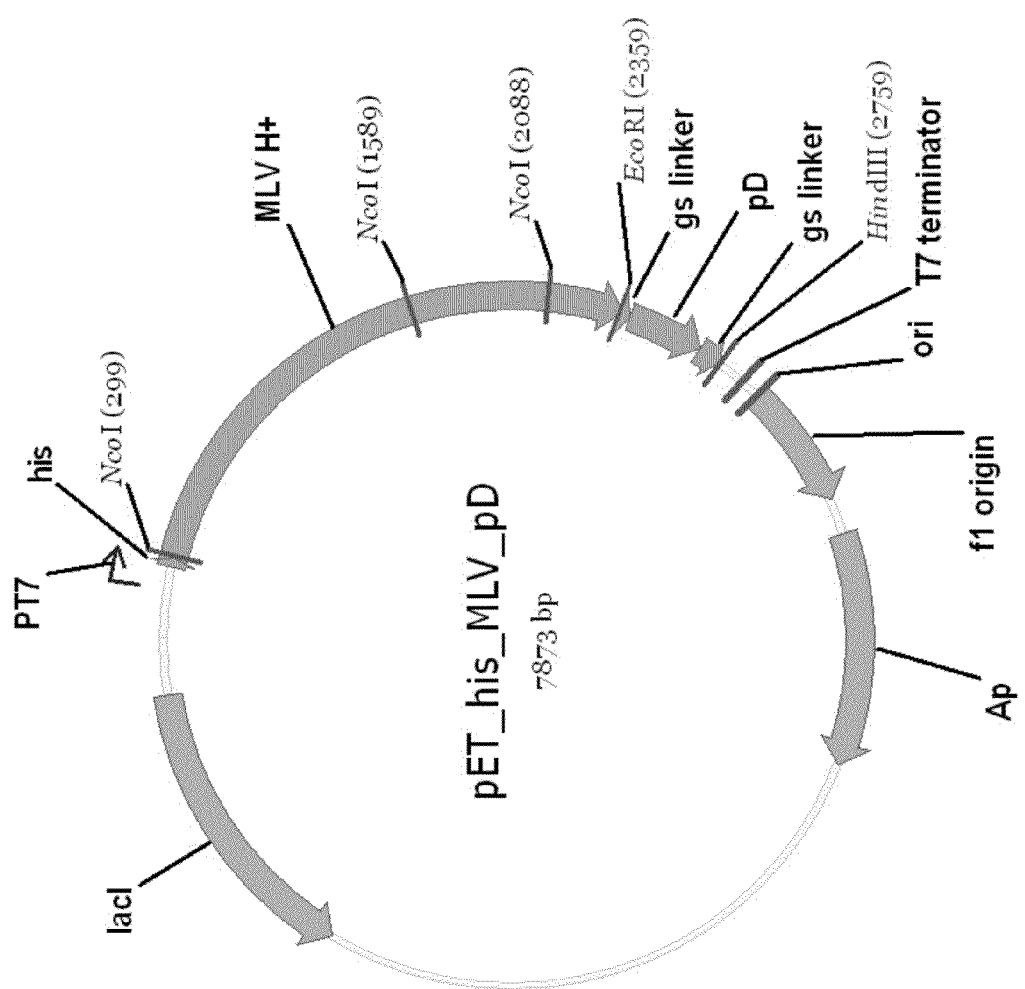

FIG. 2. The structural scheme of pET_his_MLV_pD plasmid.

Figure 3:
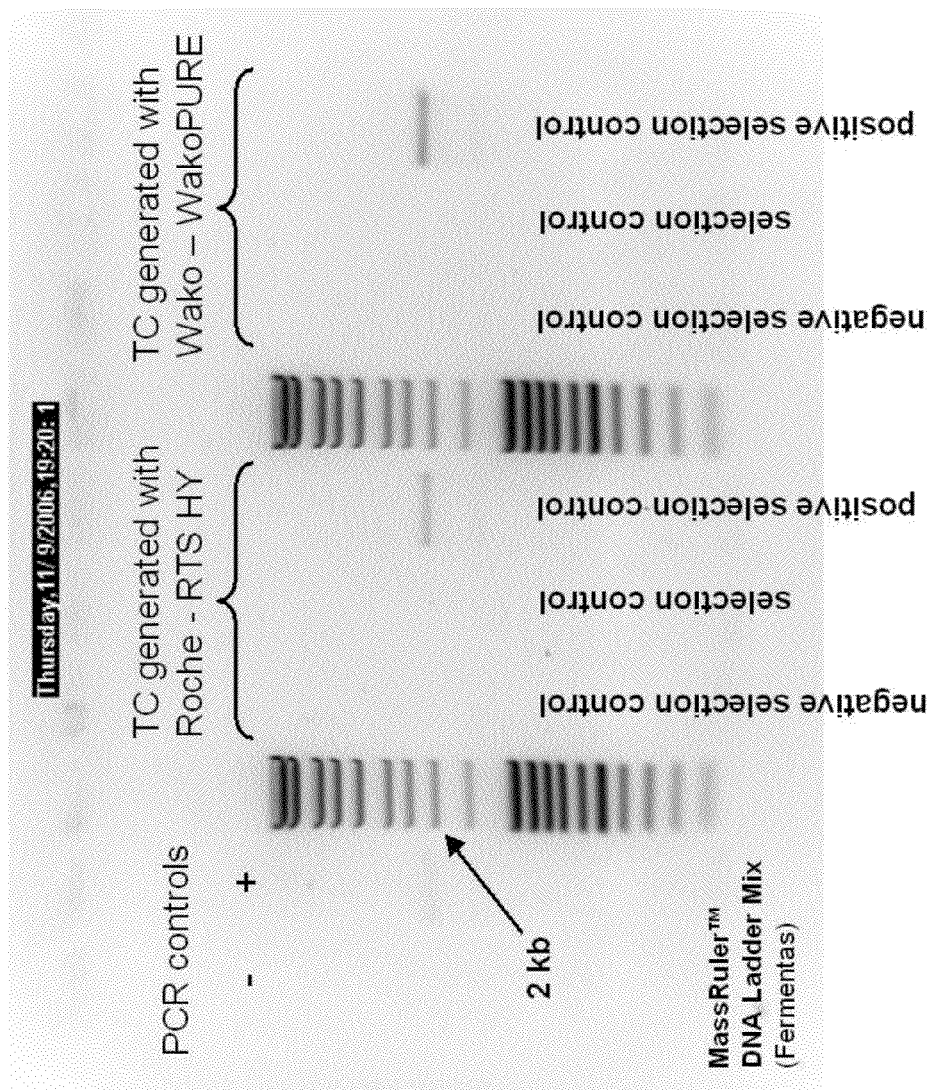

FIG. 3. Example 1—the agarose gel electrophoresis of first PCR performed on cDNA synthesized during CRD selection. Primers used: RD_Nde (SEQ ID No: 9) and pD__55 (SEQ ID No: 10). Expected length of PCR fragments was 2185 bp for MLV_pD and 2014 bp for del_pD. Amplification was analyzed on 1% agarose gel loading 10 µl of PCR mix per well.

Figure 4:
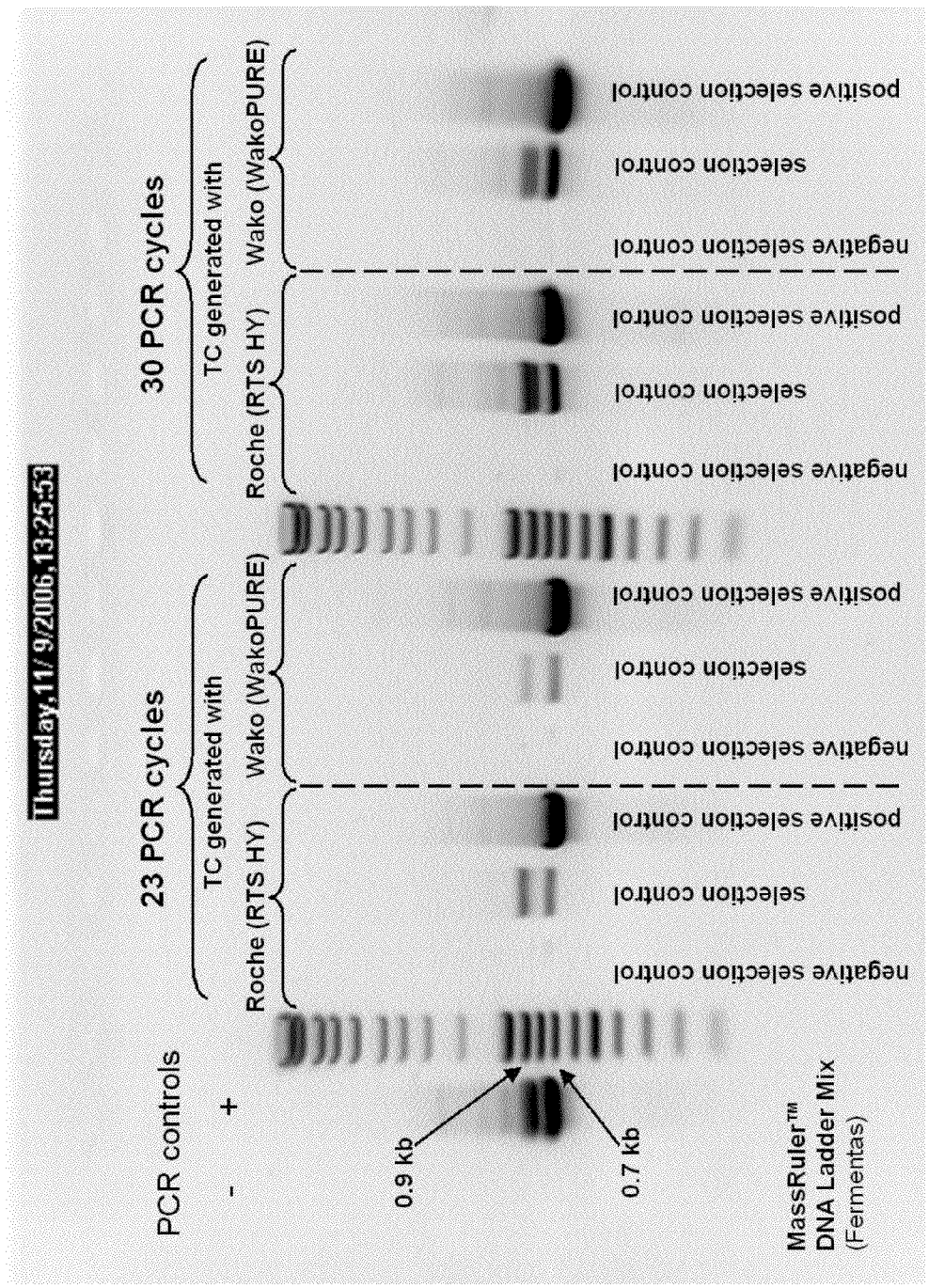

FIG. 4. Example 1—the agarose gel electrophoresis of nested PCR for partial gene amplification performed on first PCR product. Primers used: M_F (SEQ ID No: 11) and M__2R (SEQ ID No: 12). Expected length of PCR fragments was 907 bp for MLV_pDa and 736 bp for del_pD. Amplification was analyzed on 1% agarose gel loading 10 µl of PCR mix per well.

Figure 5:
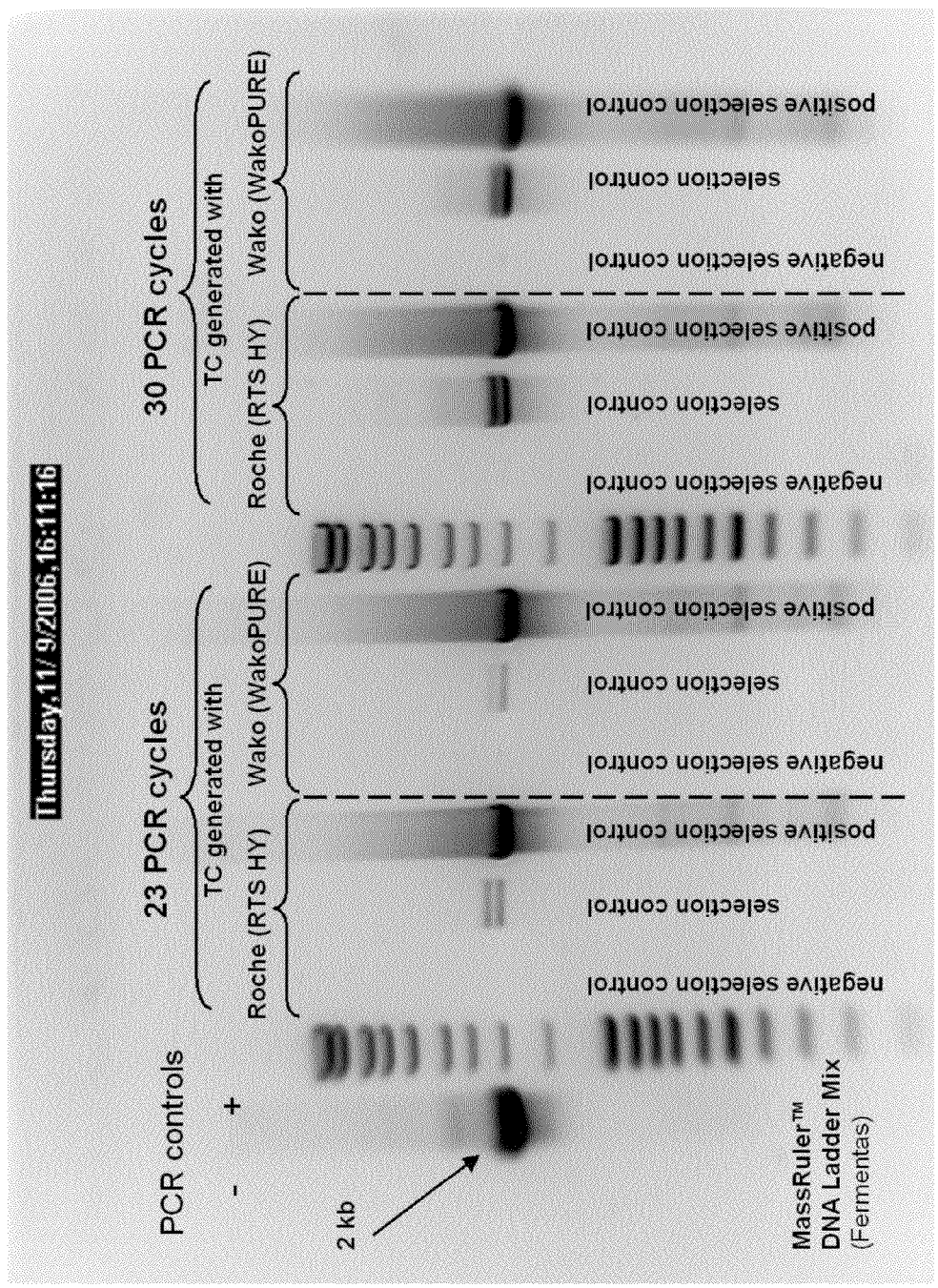

FIG. 5. Example 1—the agarose gel electrophoresis of nested PCR for full gene amplification performed on first PCR product. Primers used: M_Esp (SEQ ID No: 13) and M_Eri (SEQ ID No: 14). Expected length of PCR fragments was 2077 bp for MLV_pDa and 1906 bp for del_pD. Amplification was analyzed on 1% agarose gel loading 10 µl of PCR mix per well.

Figure 6:
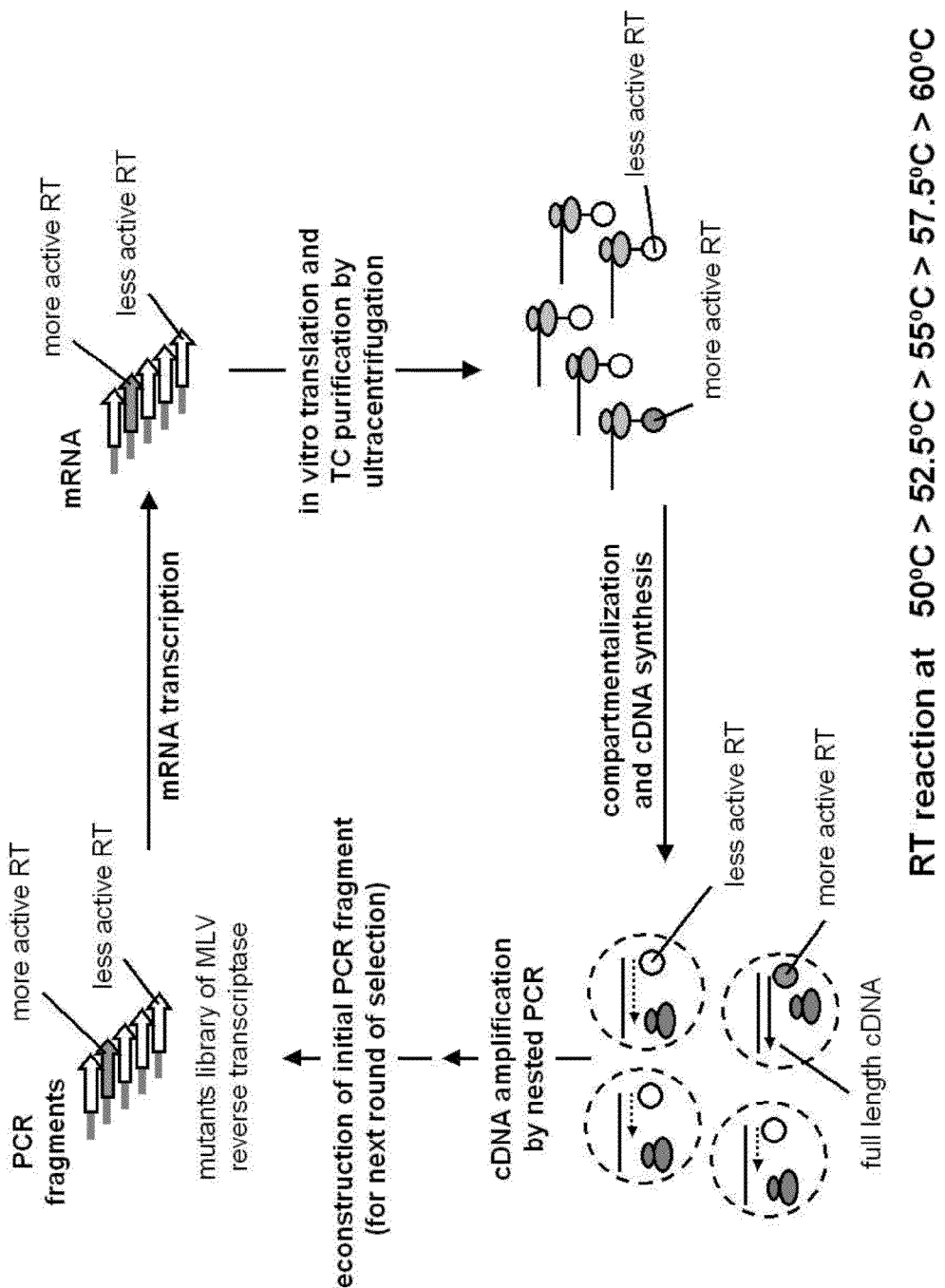

FIG. 6. The experimental scheme of CRD selection in Example 2. PCR fragments encoding mutants library of reverse transcriptase (in fusion with protein D) MLV_pD was used to synthesize mRNA. Purified mRNA was used for in vitro translation reaction. Ternary complexes (TC) of mRNA-ribosome-MLV_pD (tRNA) were formed in translation mixture and stabilized by low temperature and high concentration of $Mg^{2+}$ ions. Mixture of TC was purified by ultracentrifugation on sucrose cushions. Precipitated TC was dissolved in ice-cold buffer (50 mM $Mg^{2+}$) and used to prepare reverse transcription reaction mix supplemented with external dNTP set and primer for RT reaction. Ice-cold RT reaction mixture was emulsified giving ~$1*10^{10}$ water in oil compartments ~2 µm in size. Optimal reaction temperature of MLV RT is ~42° C. In order to select for reverse transcriptase variants, which are working better at higher temperatures emulsified RT reaction mixture (less than one TC (mRNA+MLV RT) per compartment) was incubated for 1 hr at 50° C. At this temperature successful synthesis of full length cDNA was performed better in compartments containing more active or thermostable MLV reverse transcriptase variants. Subsequent PCR was used to amplify full length cDNA and enrichment of more active and thermostable reverse transcriptase genes was performed. By PCR amplified genes were moved back to CRD format restoring intact 5' (START fragment—T7 polymerase promoter, SD and his-tag coding sequences) and 3' (END fragment—gs linker, protein D and second gs linker) sequences by ligation PCR. Reconstructed PCR fragment, containing enriched library of reverse transcriptase genes, was used for subsequent mRNA transcription and next CRD selection round. Each selection round was performed at higher and higher temperatures of RT reaction: 50° C. ($1^{st}$ round); 52.5° C. ($2^{nd}$ round); 55° C. ($3^{rd}$ round); 57.5° C. ($4^{th}$ round) and 60° C. ($5^{th}$ round).

Figure 7:
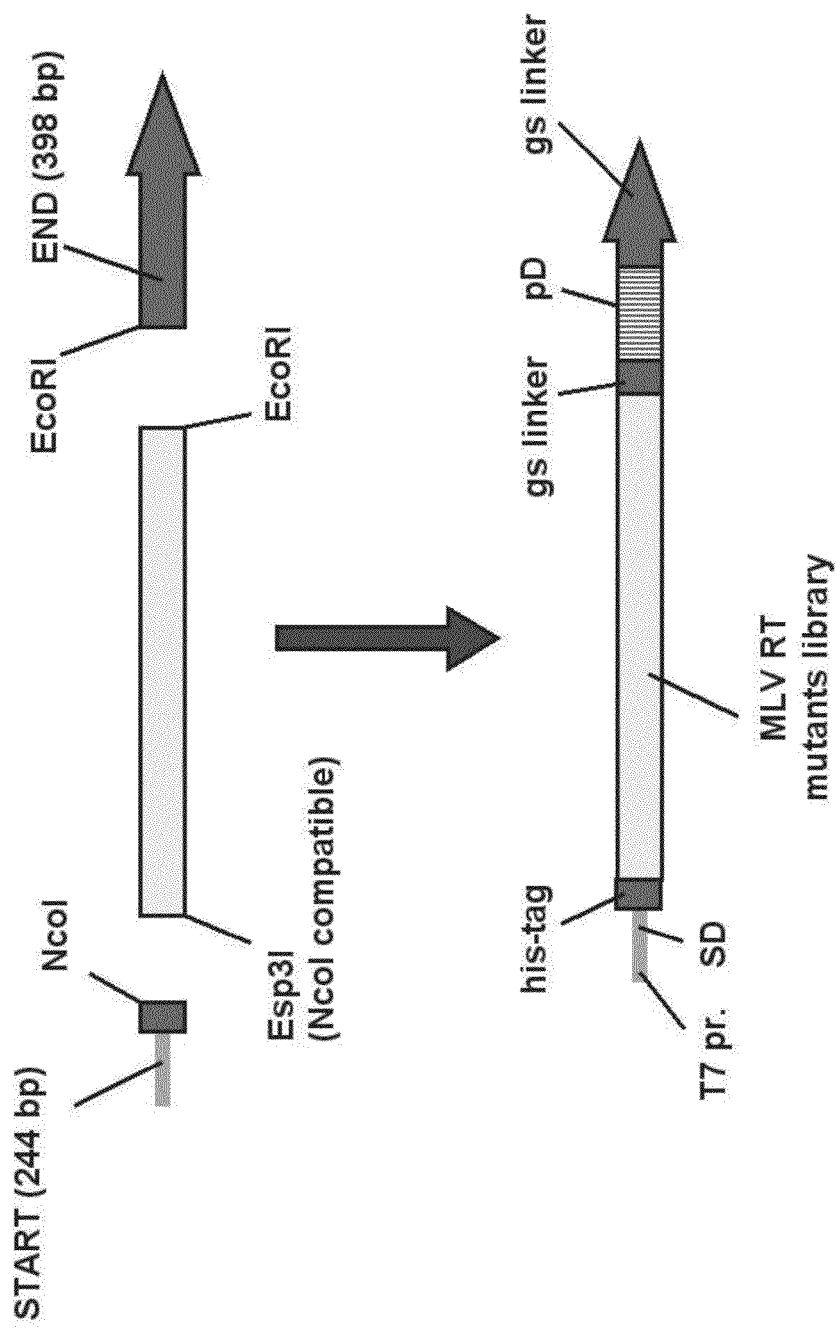

FIG. 7. The scheme of PCR fragment reconstruction before new round of CRD selection. Mutated MLV RT library was digested with Esp3I (NcoI compatible end) and EcoRI and ligated with START (244 bp) and END (398 bp) fragments in order to get PCR fragment suitable for CRD selection. START fragment (containing T7 polymerase promoter, SD and his-tag coding sequences) was constructed by PCR amplification of initial 983 bp START fragment (target—plasmid pET_his_del_pD (SEQ ID No: 2), primers—pro-pIVEX (SR) ID No: 3) and M__1R (SEQ ID No: 15)) and subsequent digestion with NcoI (recognition sequence C↓CATGG) giving 244 bp DNA fragment. END fragment (containing gs linker, protein D and second gs linker sequences) was constructed by PCR amplification of initial 1039 bp END fragment (target—plasmid pET_his_del_pD (SEQ ID No: 2), primers—M__3F (SEQ ID No: 16) and pD-ter (SEQ ID No: 4)) and subsequent digestion with EcoRI (recognition sequence G↓AATTC) giving 398 bp DNA fragment.

Figure 8:
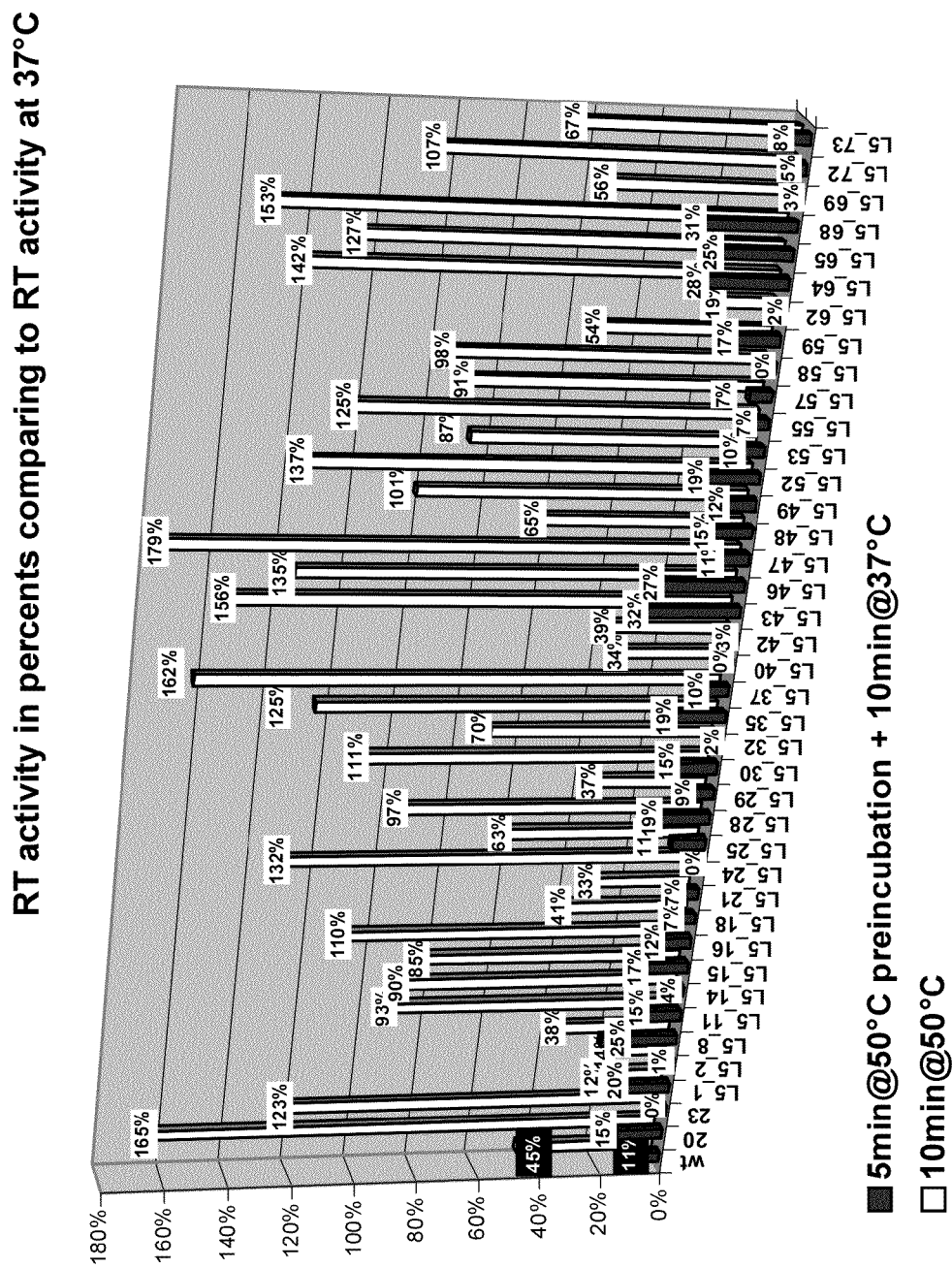

FIG. 8. Reverse transcriptase activities of mutant RT variants measured at 37° C., 50° C. and residual activity at 37° C. after 5 min incubation at 50° C. Reverse transcriptase activity at 37° C. is normalized to be always 100% and is omitted. Thus only two types of columns (percents of RT activity at 50° C. and residual RT activity at 37° C. after 5 min incubation at 50° C.) are shown. As a control is given wt M-MuLV reverse transcriptase used for mutants library construction. This primary enzyme is expressed in the same vector and purified in the same way as mutant variants of RT. An average value of mutant RT activity at 50° C. for all tested mutants is about ~92% and is more than 2 times higher comparing to wt enzyme (45%). An average residual activity of mutant RT variants at 37° C.⁻ after 5 min preincubation at 50° C. is 12% (wt enzyme—11%).

Figure 9:
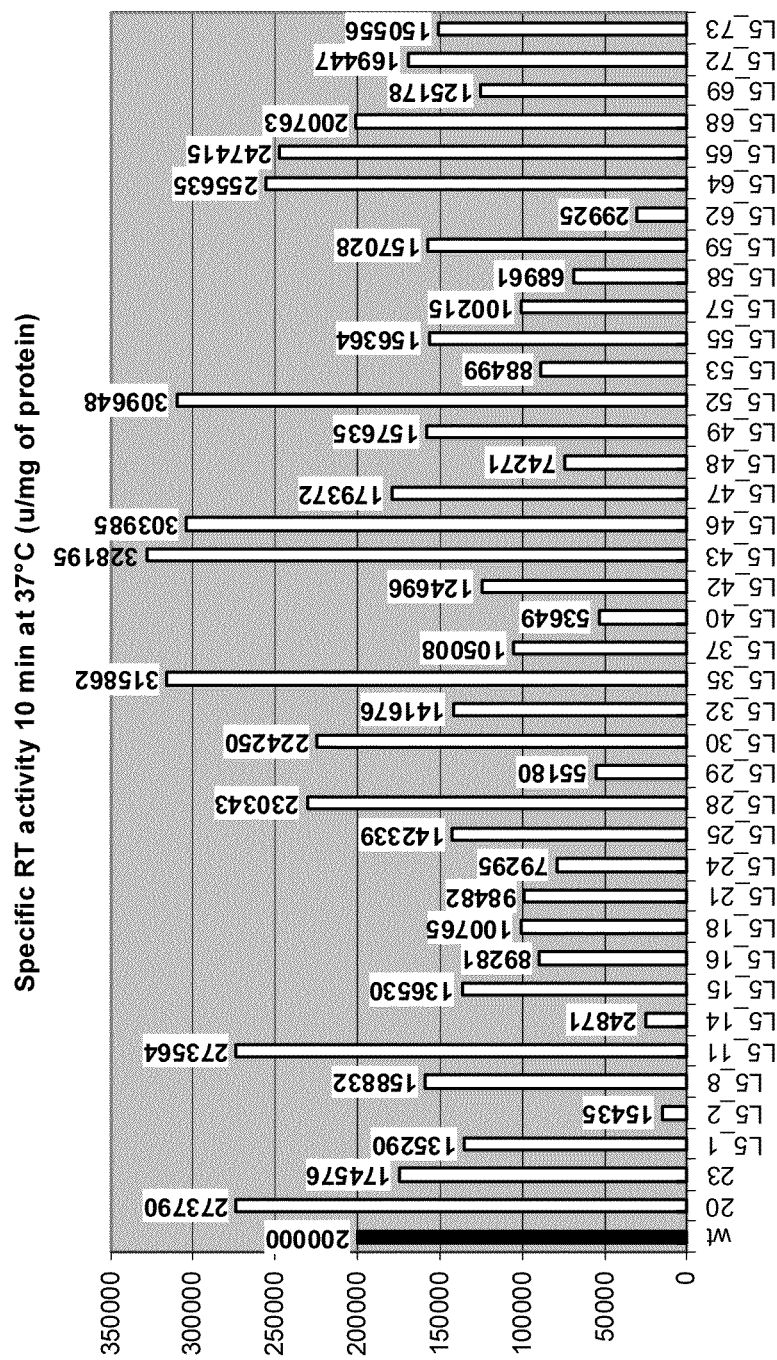

FIG. 9. Specific activity (u/mg of protein) of partially purified wt and mutant RT variants measured 10 min at 37° C.

FIG. 10. The proposed experimental scheme of CRD selection using FACS. Protein of interest is displayed in ribosome display format. Purified (or just diluted many times) ternary complex comprising mRNA-ribosome-protein (tRNA) is mixed with non fluorescent substrate (S) in reaction buffer and subsequently emulsified producing double water-in-oil-in-water emulsions. Active variants of compartmentalized enzymes will convert substrate (S) to fluorescent product (P) allowing FACS to distinguish between fluorescent (active enzyme inside) and "dark" (inactive enzyme inside) droplets.

FIG. 11. The proposed experimental scheme for selection and evolution of thermostable DNA polymerases using CRD. Polymerase of interest has to be displayed in ribosome display format. Optionally purified (or just diluted many times) ternary complex comprising mRNA-ribosome-polymerase can be used to prepare reaction mixture with reverse transcriptase (helper enzyme), dNTP's and primer set in PCR buffer. Reaction solution should be emulsified producing water-in-oil emulsion. In first RT step—reverse transcriptase has to synthesize cDNA, which subsequently will serve as a target for second PCR step—cDNA amplification by ribosome displayed DNA polymerase. One of the primers used in PCR can have biotin for optional subsequent purification with streptavidin beads and non-complementary 5' end. After RT-PCR emulsions should be broken, newly synthesized DNA fragment can be purified via biotin and reamplified using new primer set, which will contain one primer with sequence non-complementary to cDNA, but identical to 5' part of primer used in first amplification reaction (selective amplification of DNA over cDNA background). More active variants of DNA polymerase will be enriched over less active variants and can be used for further analysis or next selection round.

Figure 12:
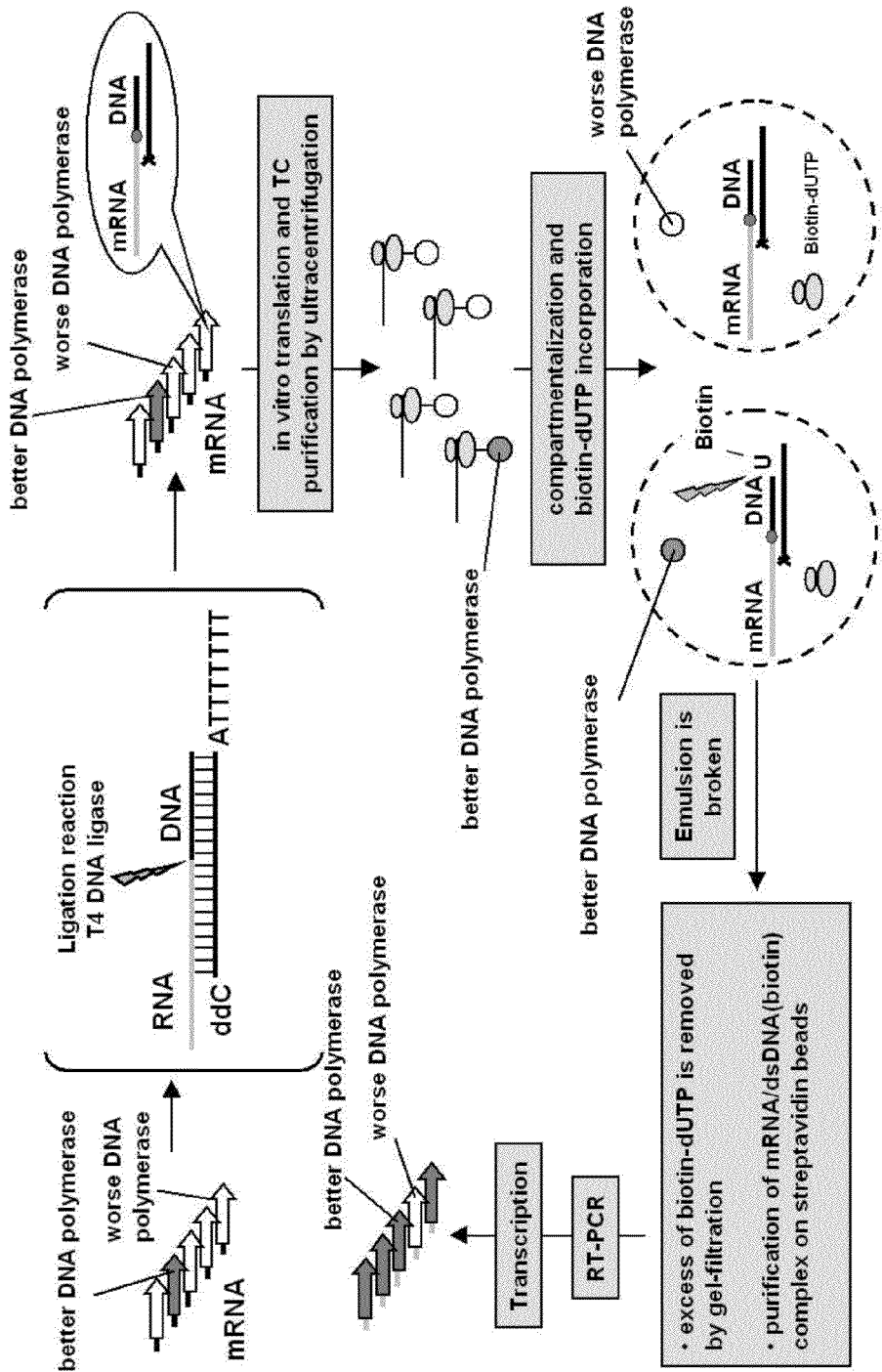

FIG. 12. The experimental scheme of Example 4. In this experimental setup M-MuLV reverse transcriptase is used as DNA dependent DNA polymerase. Two plasmids pET_his_MLV_D583N_pD (encoding RNase H minus Moloney Murine Leukemia Virus (M-MLV) reverse transcriptase fused to protein D spacer) and pET_his_del_pD (encoding inactivated reverse transcriptase fused to protein D spacer—57 amino acids deletion in pol domain and point mutation D583N in RNase H domain) were used to synthesize PCR fragments. PCR fragments furtheron are used in transcription reaction. Purified mRNA is mixed with ratio 1:20=MLV_D583N_pD (active RT):del_pD (inactive RT) and used to prepare mRNA/dsDNA complex by dsDNA ligation to mRNA mix using T4 DNA ligase. mRNA/dsDNA complex was used for in vitro translation reaction. During translation reaction ribosomal complex synthesizes protein and stops at the end of mRNA (at the beginning of mRNA/DNA hybrid). Mixture of ternary complexes (TC) is purified by ultracentrifugation on sucrose cushions. Purified ternary complexes (<3*10$^9$ molecules taken) already containing mRNA/dsDNA linked to in vitro translated polymerase (M-MuLV reverse transcriptase) are used to prepare elongation reaction mix supplemented with external biotin-dUTP. Ice-cold reaction mixture is emulsified giving ~1*10$^{10}$ water in oil compartments ~2 μm in size. Emulsified elongation reaction mixture (less than one TC (mRNA/dsDNA+polymerase) per compartment is incubated for 30 min at 37° C. in order to incorporate biotinylated nucleotide. After the temperature of compartmentalized reaction mixture is raised most of TC dissociate releasing mRNA/dsDNA complex and polymerase. Successful incorporation reaction in to dsDNA substrate is performed only in compartments containing active polymerase (reverse transcriptase MLV_D583N_pD) and no cDNA is synthesized in compartments with inactive polymerase (del_pD). After the emulsions are broken excess of biotin-dUTP is removed using gel-filtration mini-column. Biotinylated mRNA/dsDNA complex is purified on streptavidin beads and used to synthesize cDNA. Subsequent PCR amplifies cDNA and enrichment of active polymerse (reverse transcriptase—MLV_D583N_pD) genes over inactive polymerase (del_pD) is observed.

Figure 13:
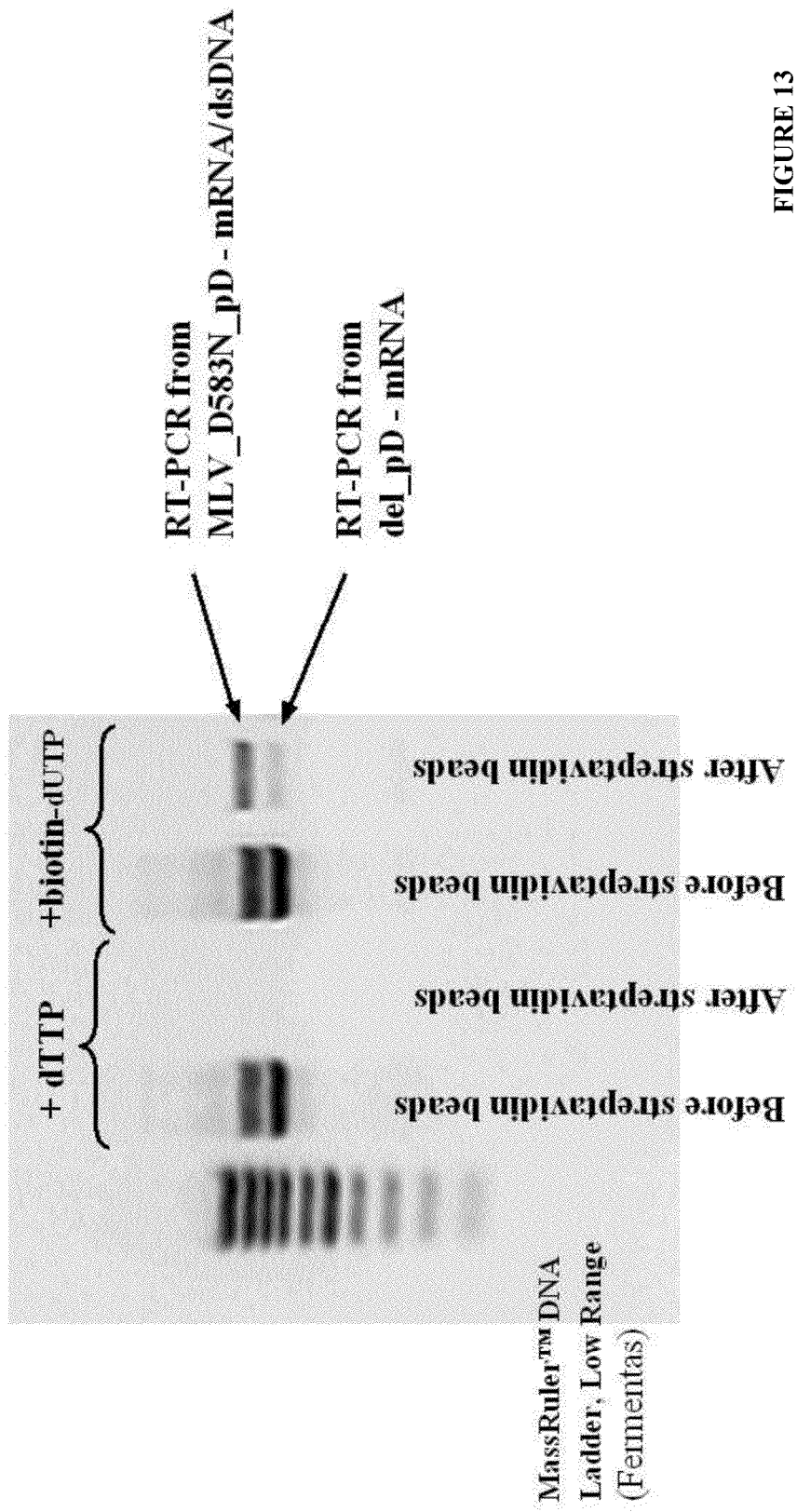

FIG. 13. Determination of biotin-dUTP incorporation efficiencies into mRNA/dsDNA complex and into self primed mRNA. Picture of RT-PCR performed on samples of mRNA/dsDNA (MLV_D583N_pD) and mRNA (del_pD) after the incorporation of dTTP or biotin-dUTP. Predicted amplicons size are 907 bp for MLV_D583N_pD and 736 bp for del_pD cDNA. PCR products were analyzed on 1% agarose gel loading 10 μl of PCR mix per well.

Figure 14:
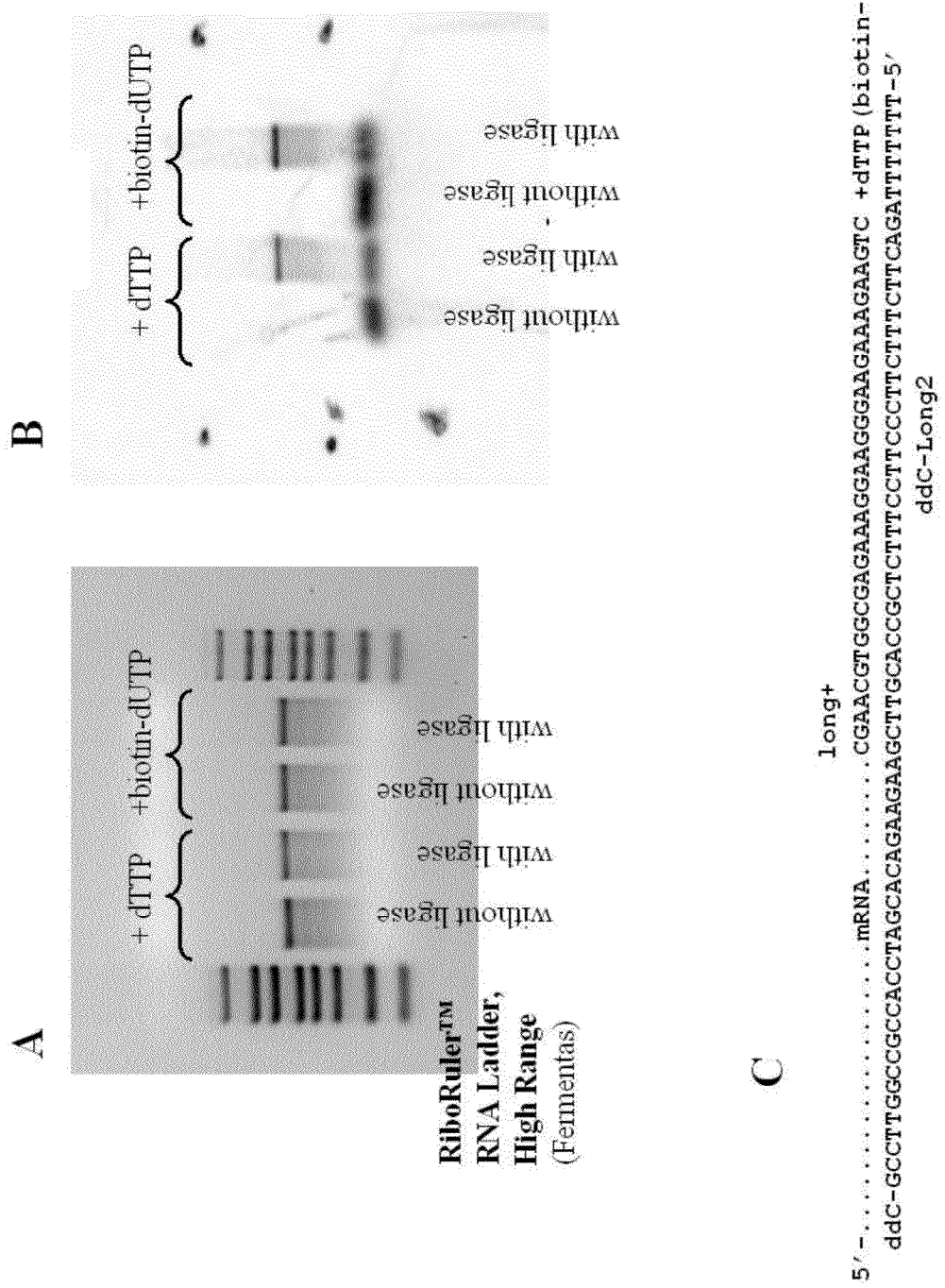

FIG. 14. General control of mRNA/dsDNA complex existence by incorporation of dTTP (biotin-dUTP) and [α-P$^{33}$] dATP. Radioactive dATP should be introduced into dsDNA substrate subsequentially after the incorporation of initial dTTP or biotin-dUTP. A ethidium bromide visualized agarose gel (mRNA or mRNA/dsDNA bands ~2.5 kb). B—the same gel as in A dried on filter paper and visualized using Cyclone Phosphor Imager (Perkin-Elmer, Wellesley, Mass.). Labelled mRNA/dsDNA complex and/or only dsDNA bands are observed. C—structure and sequence of dsDNA counterpart in mRNA/dsDNA complex SEQ ID NOs.: 21 and 22.

Figure 15:
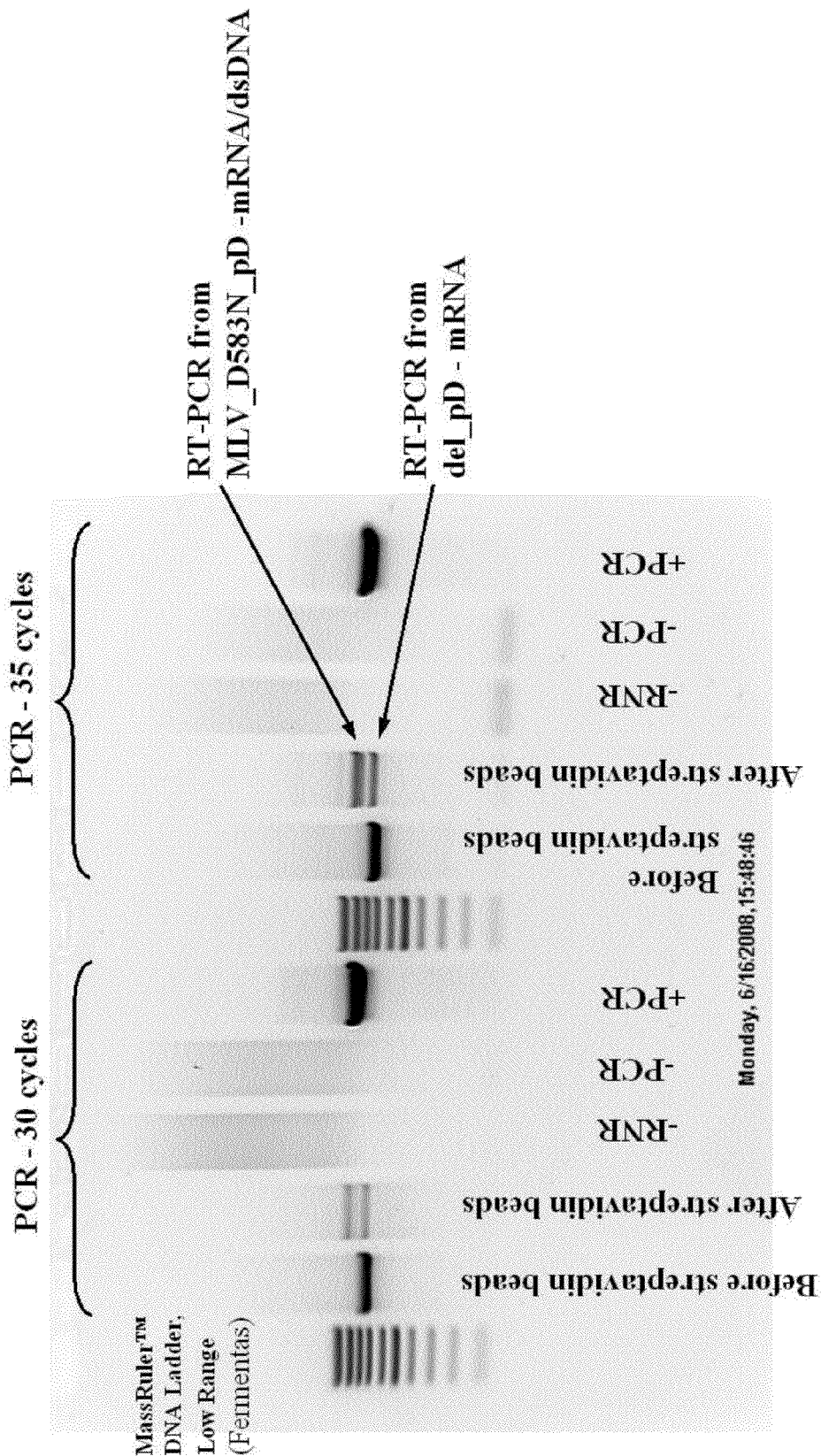

FIG. 15. The resultant final RT-PCR fragments analysis of Example 4. Predicted amplicons size are 907 bp for MLV_D583N_pD and 736 bp for del_pD cDNA. PCR products were analyzed on 1% agarose gel loading 10 μl of PCR mix per well. RT-PCR samples before streptavidin beads corresponds to the ratio of active and inactive polymerase genes 1:20 (almost only delpD fragment ~736 bp is visible). RT-PCR samples after the purification on streptavidin beads corresponds to the ratio of active and inactive polymerase genes after the single selection round ~1:1. An enrichment factor of ~20 is observed in this selection.

Figure 16:
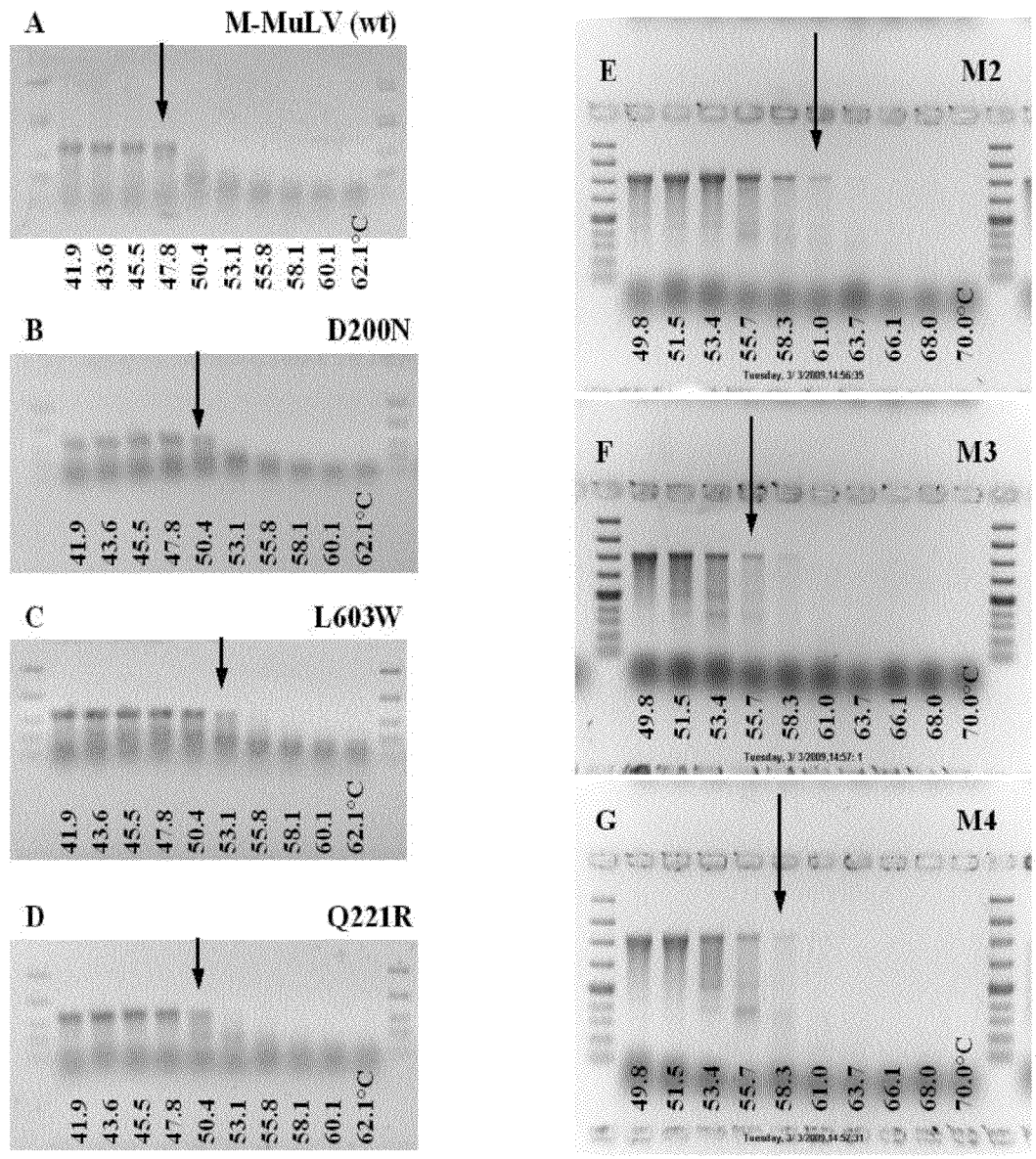
Figure 1:
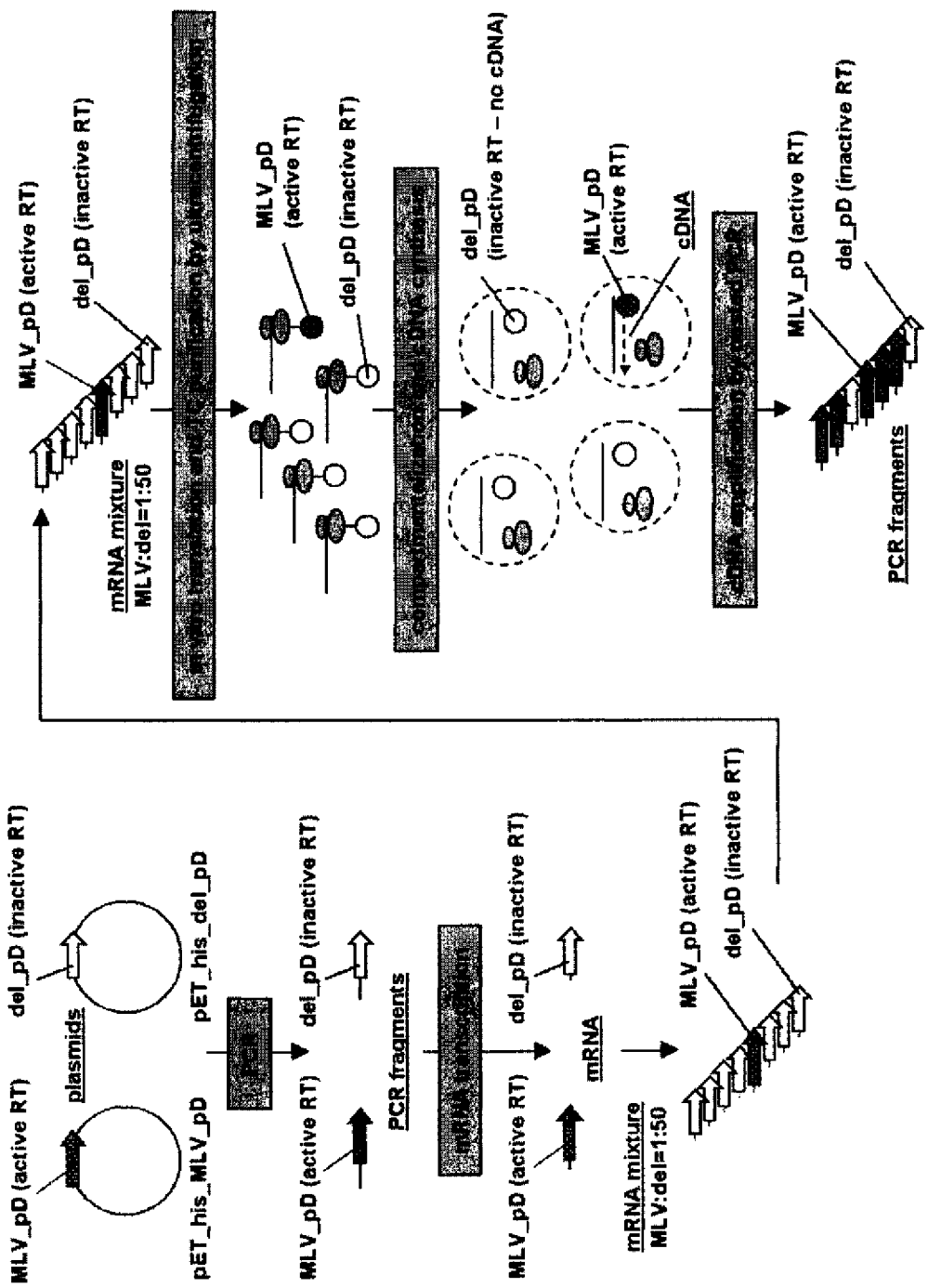
Figure 2:
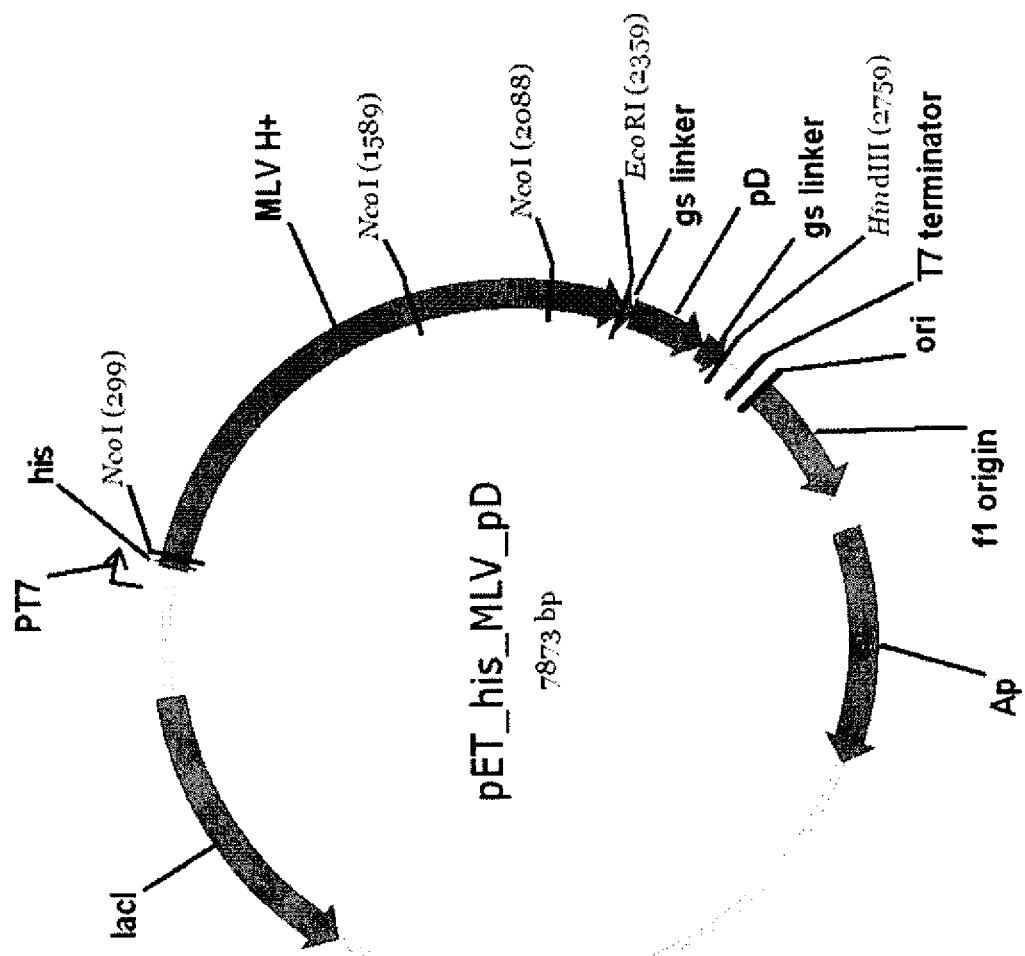
Figure 3:
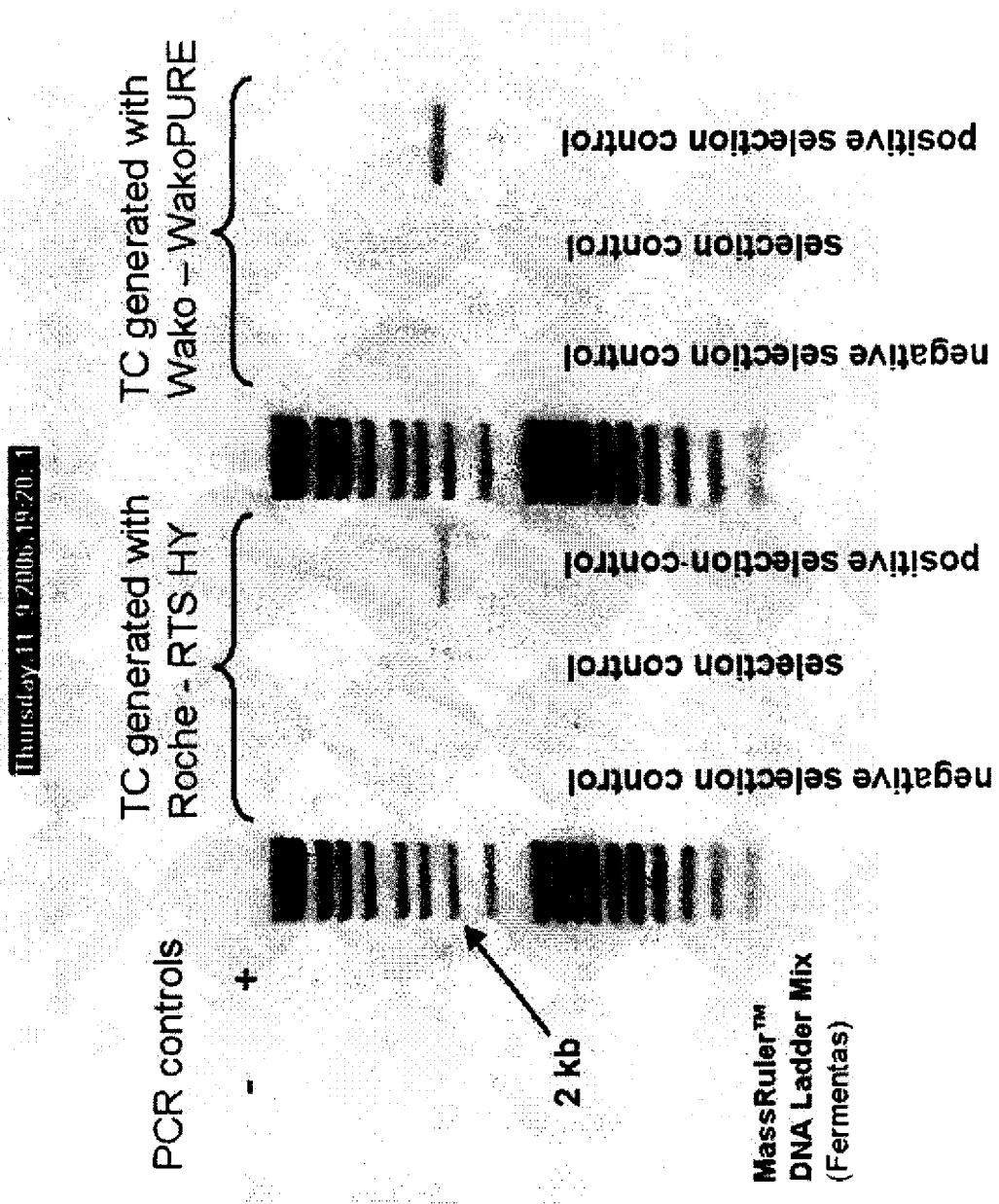
Figure 4:
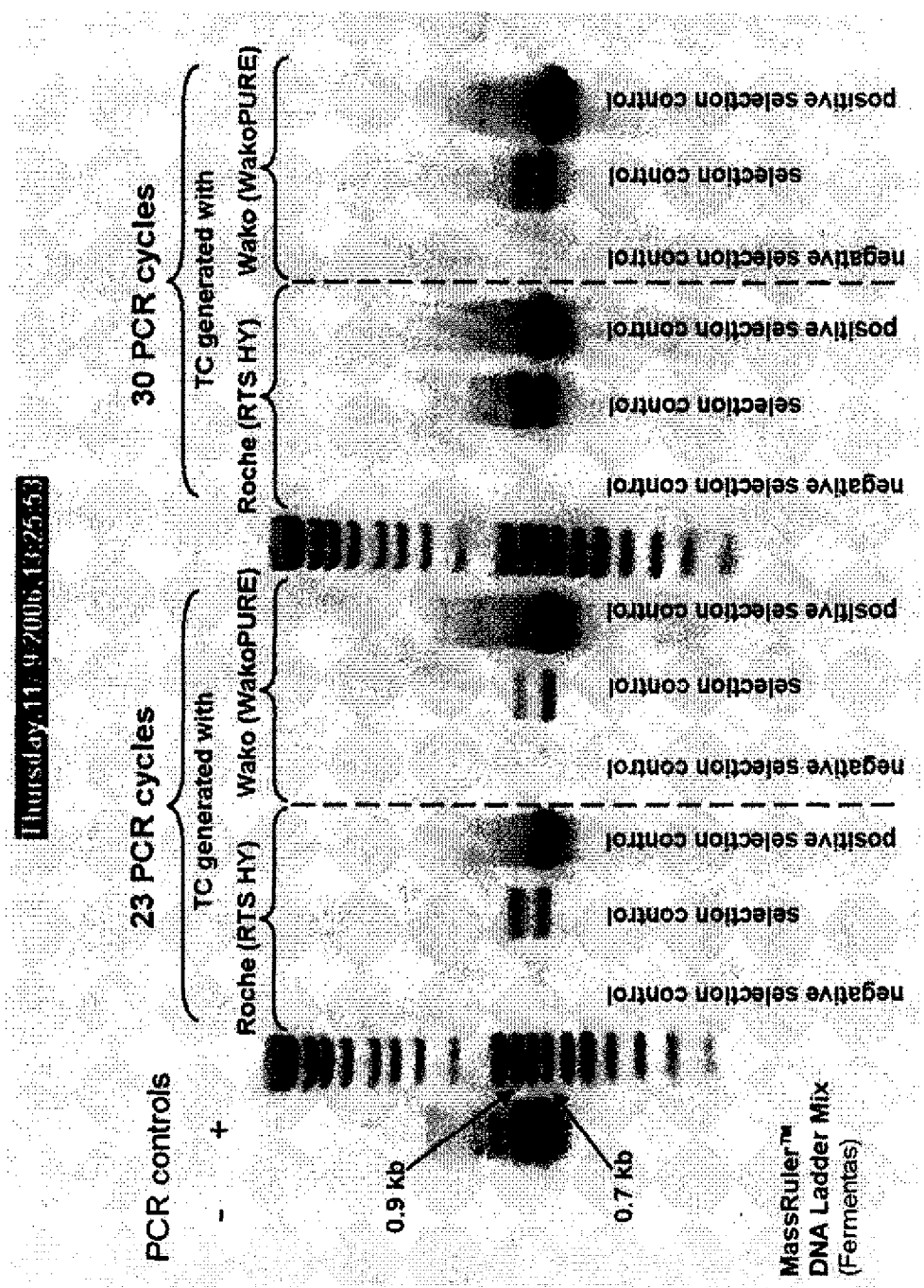
Figure 5:
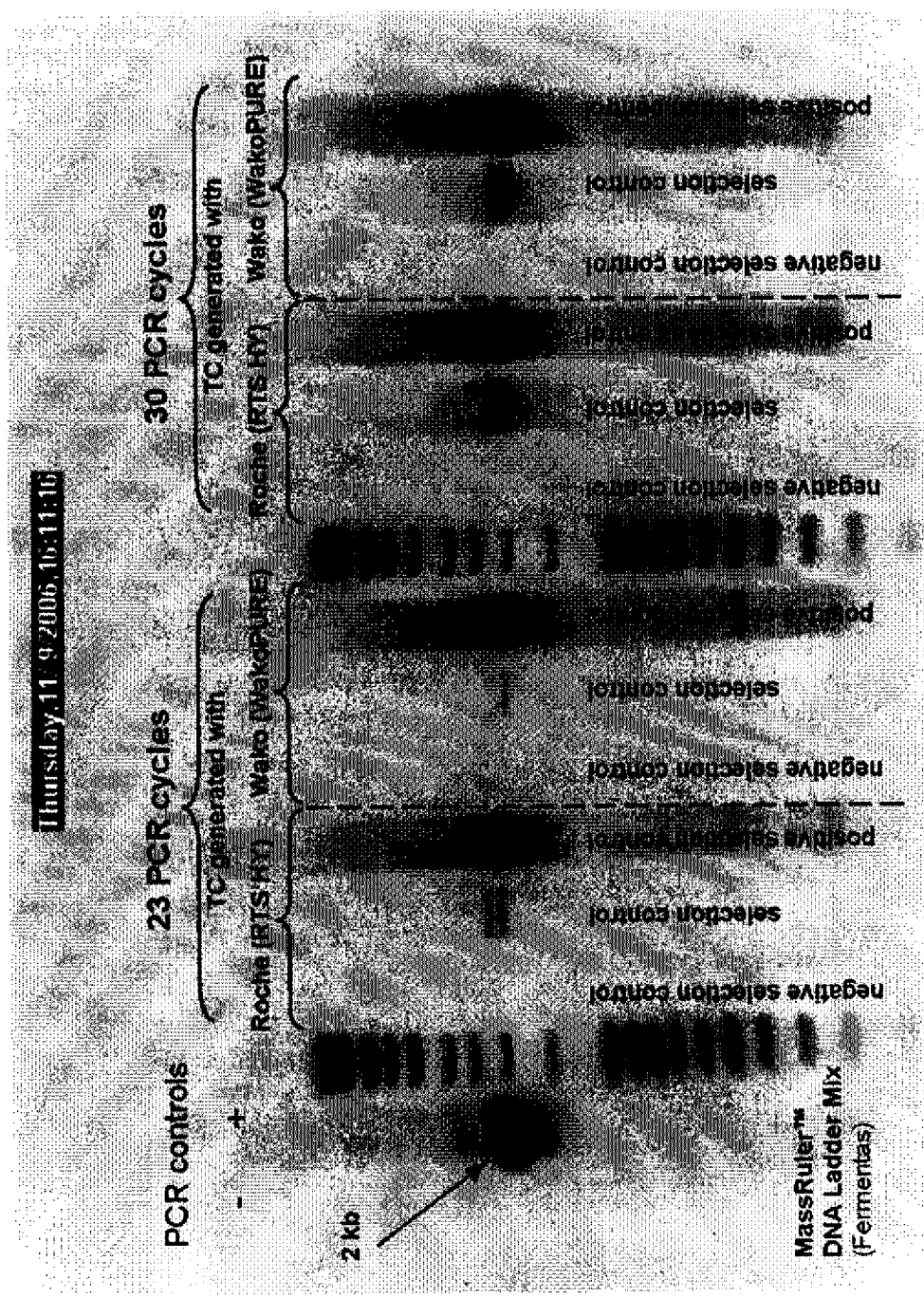
Figure 9:
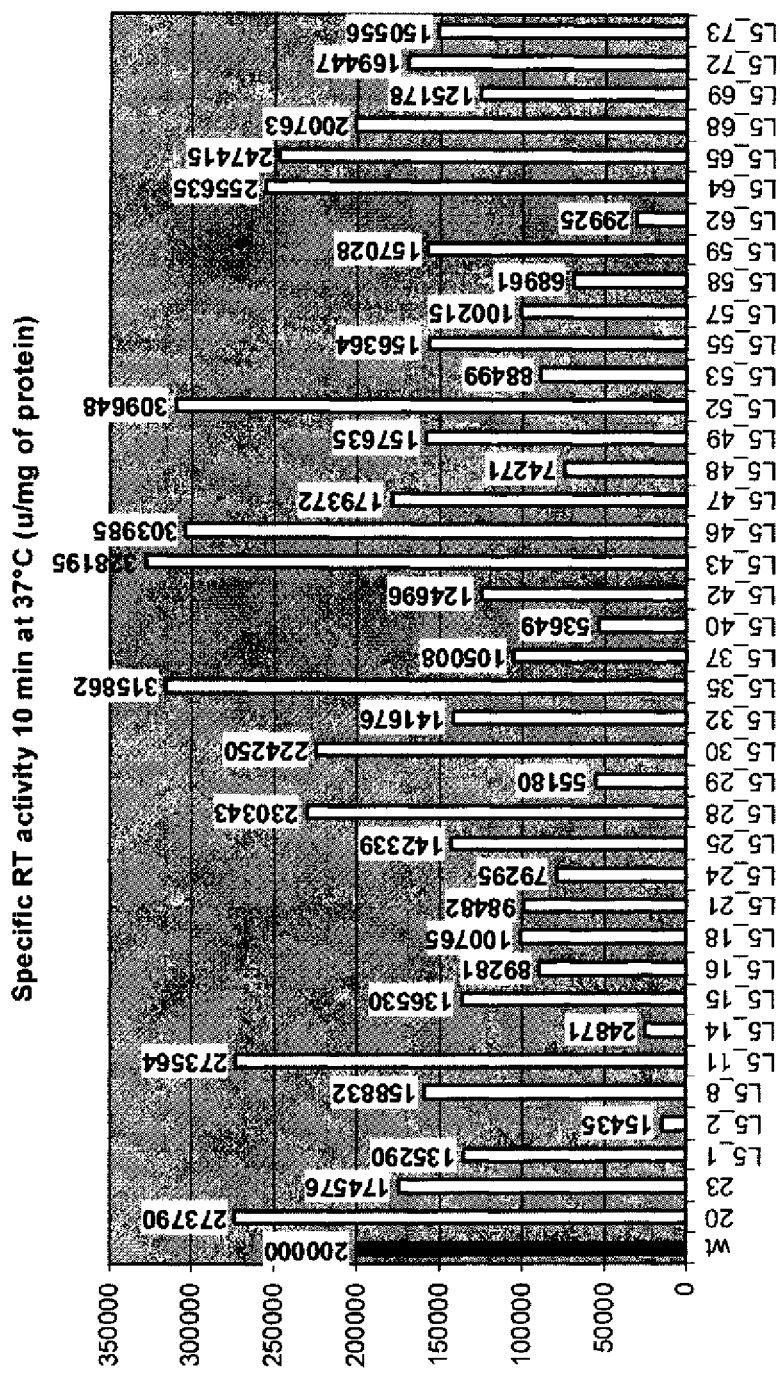
Figure 10:
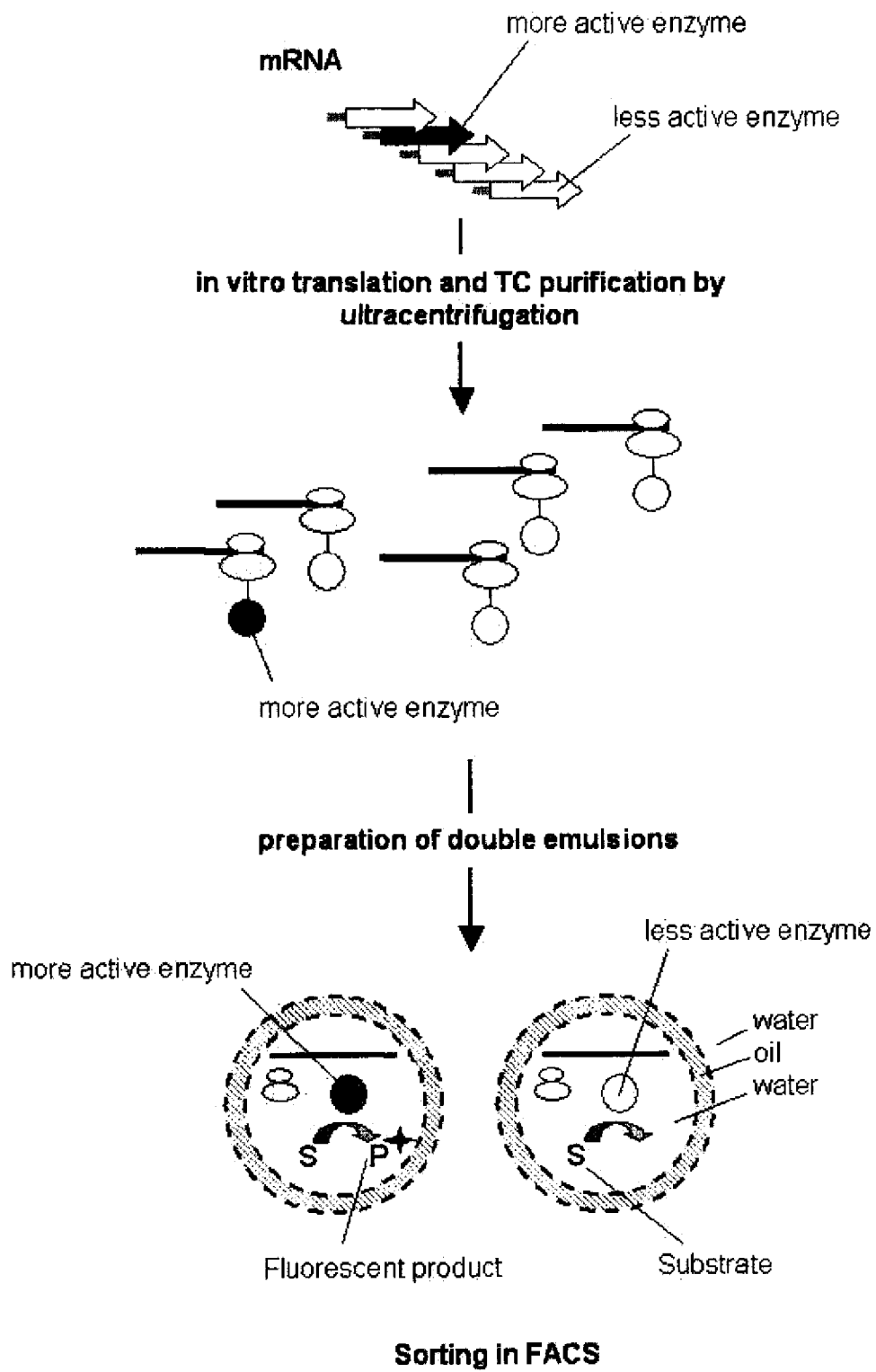
Figure 11:
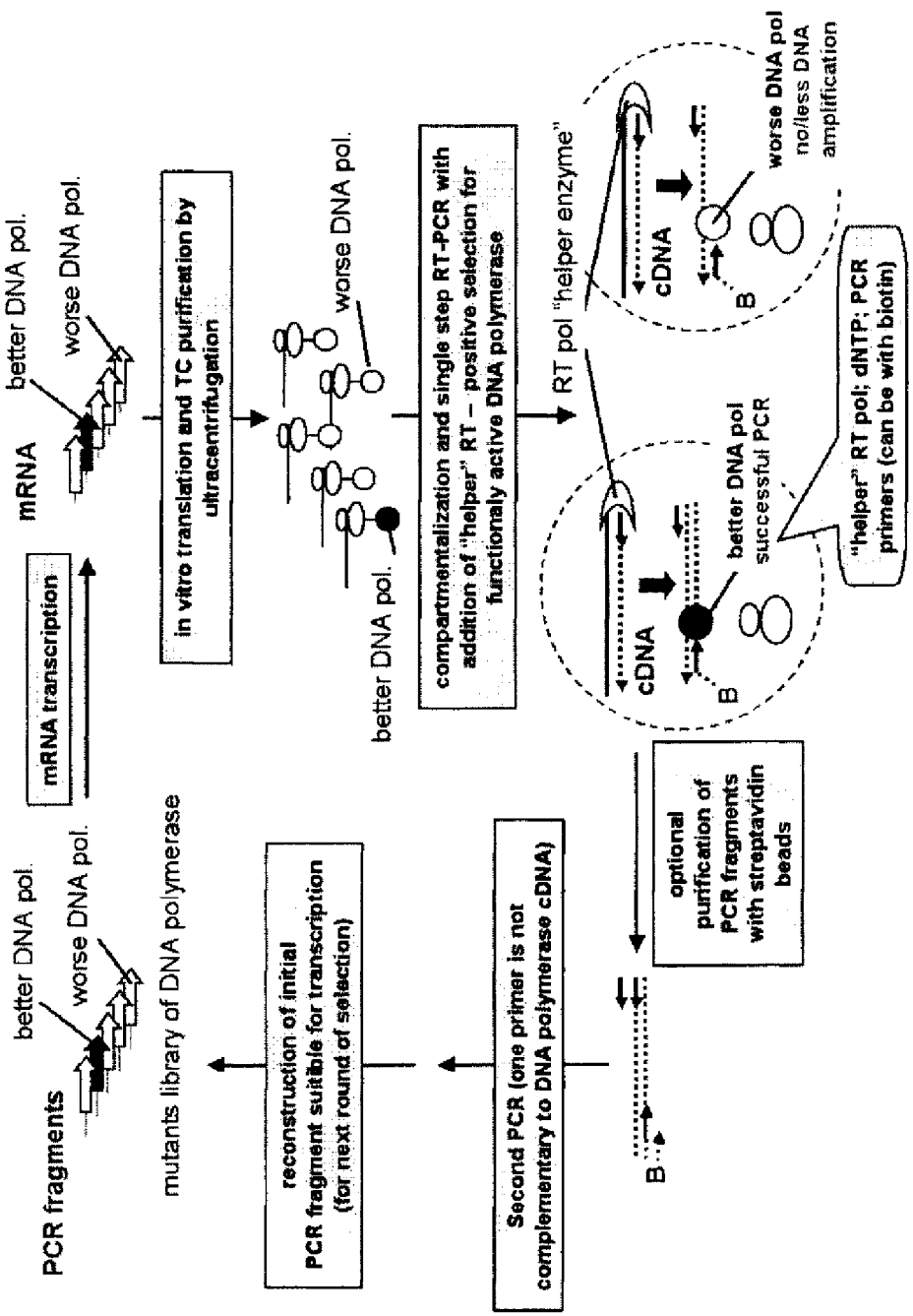
Figure 12:
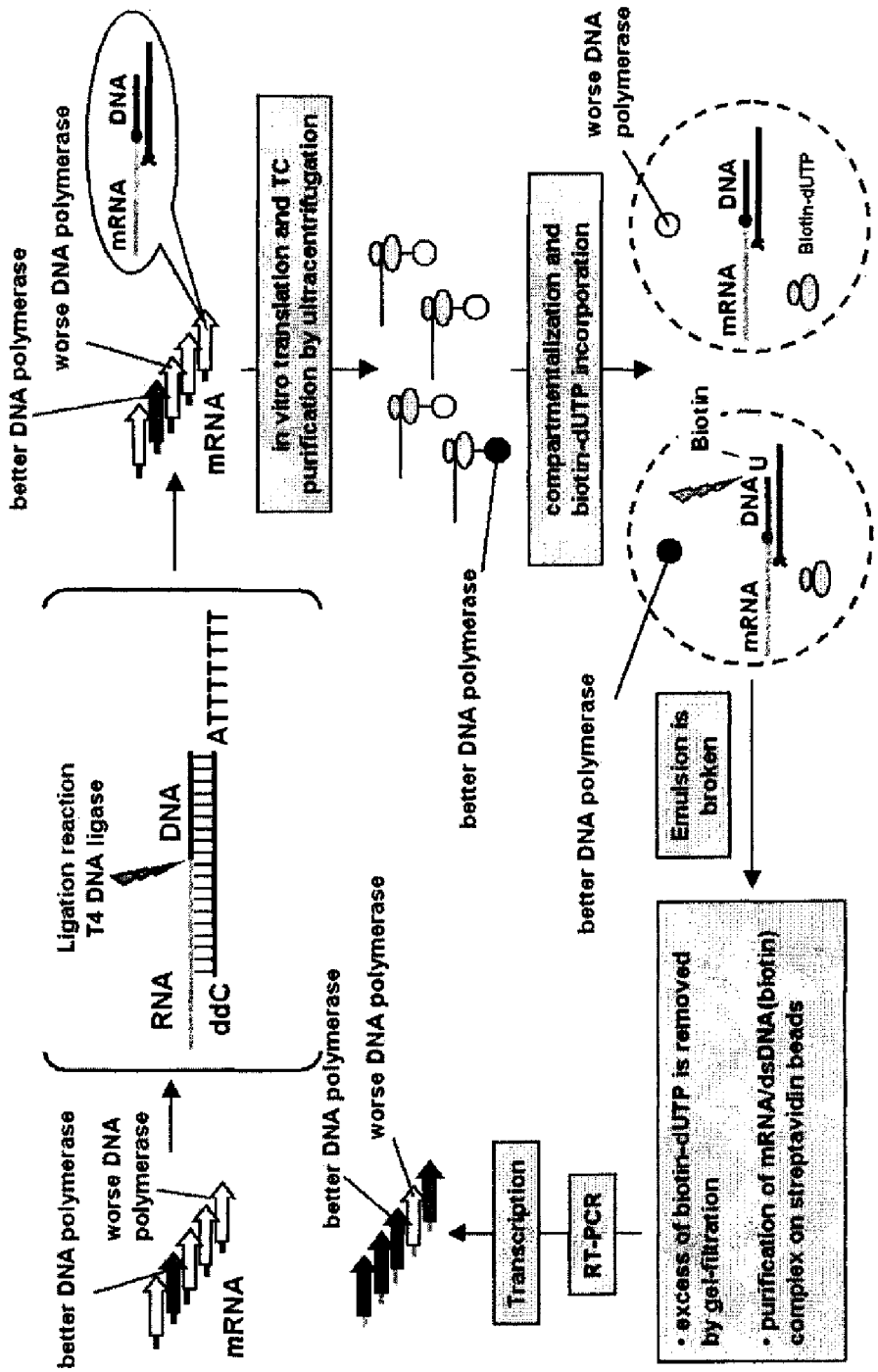
Figure 13:
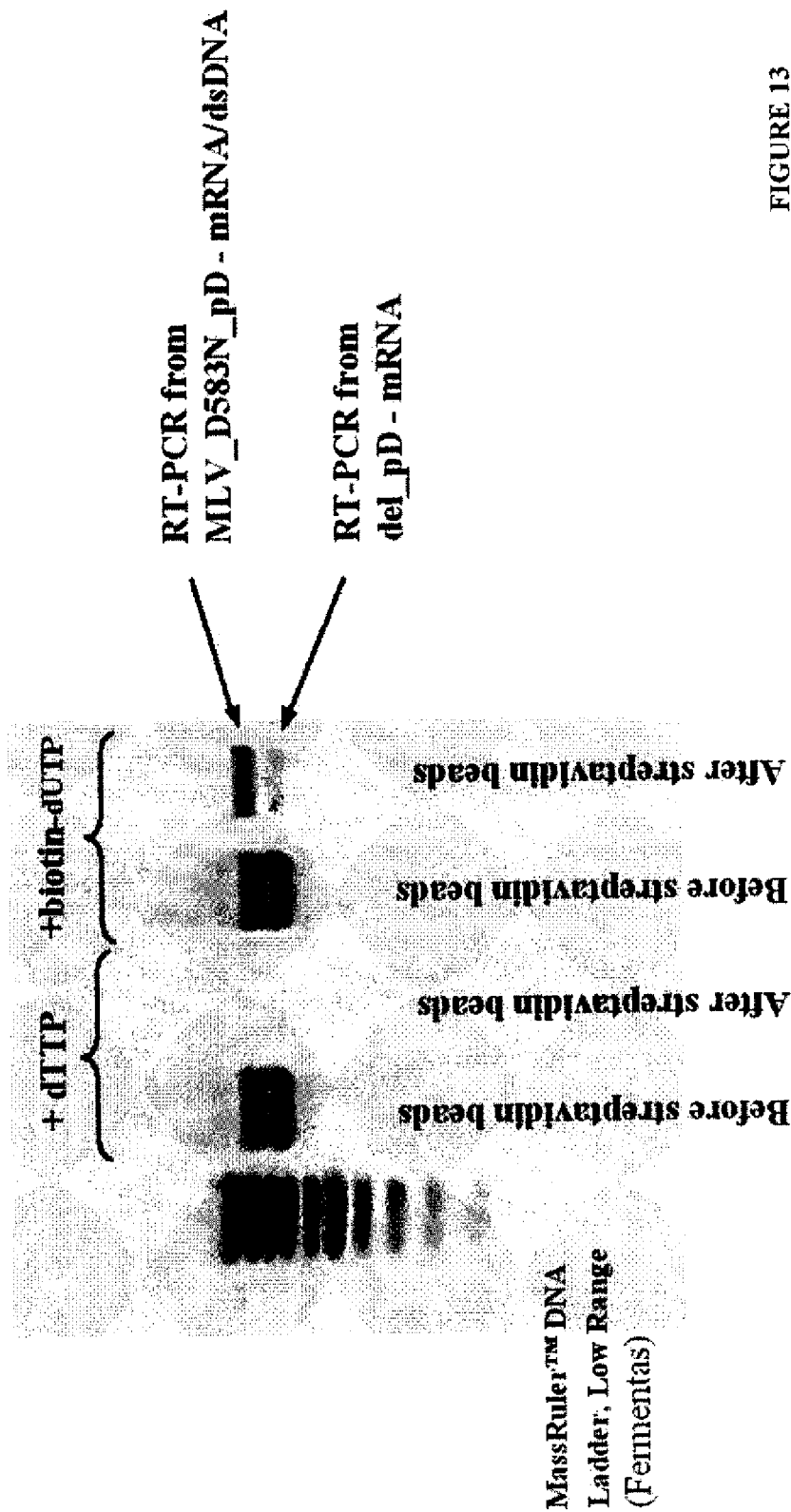
Figure 14:
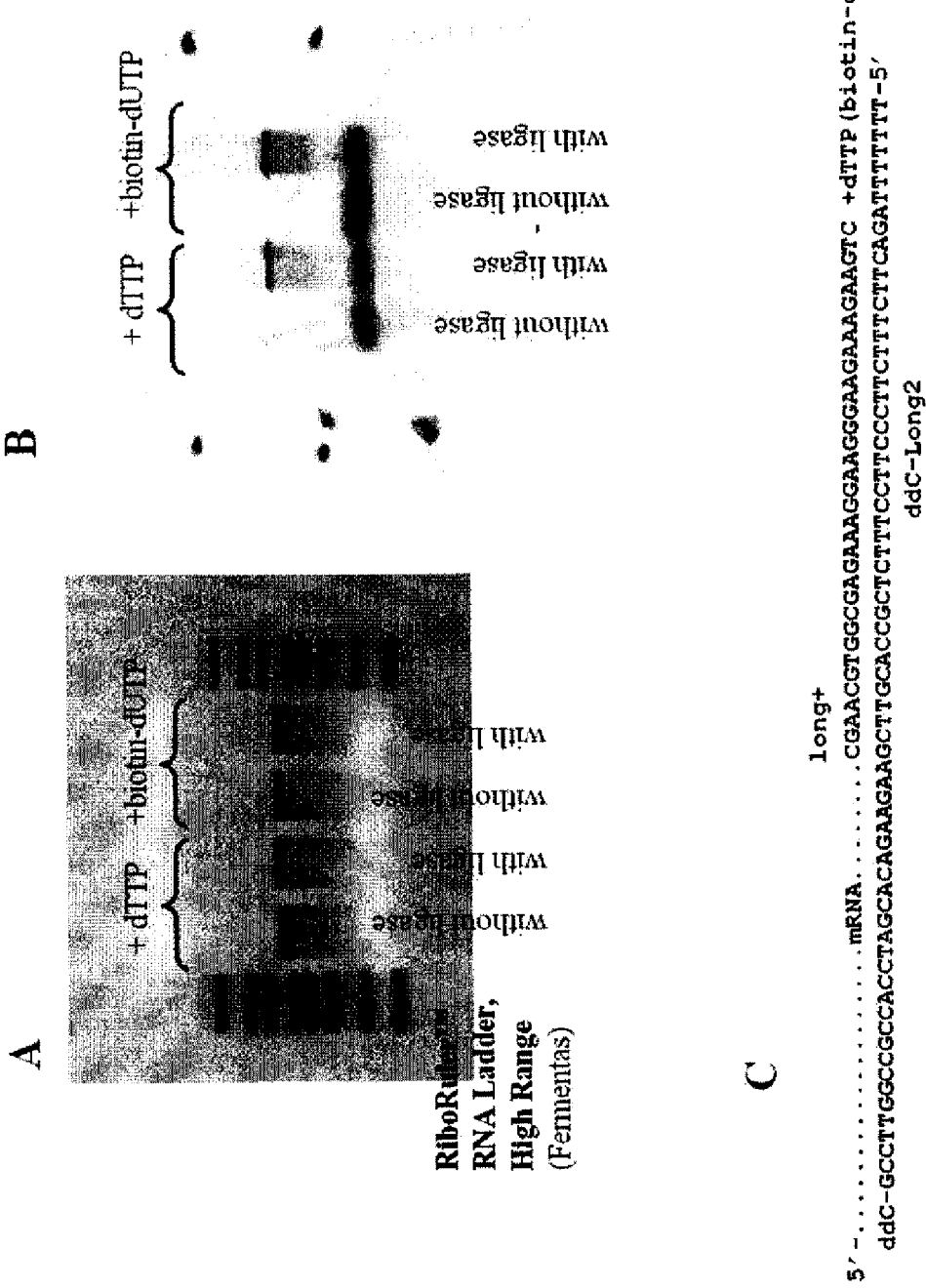
Figure 15:
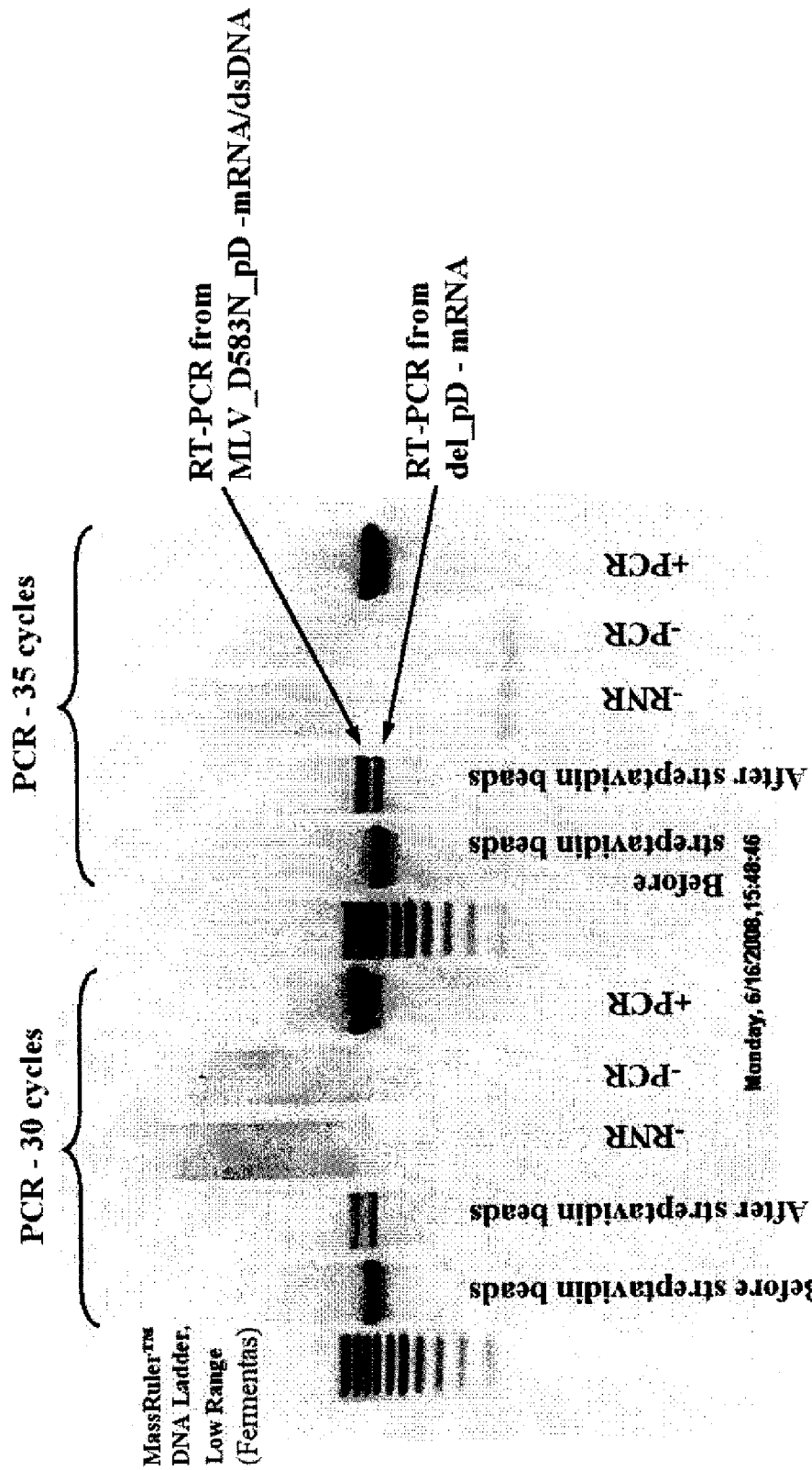
Figure 16:
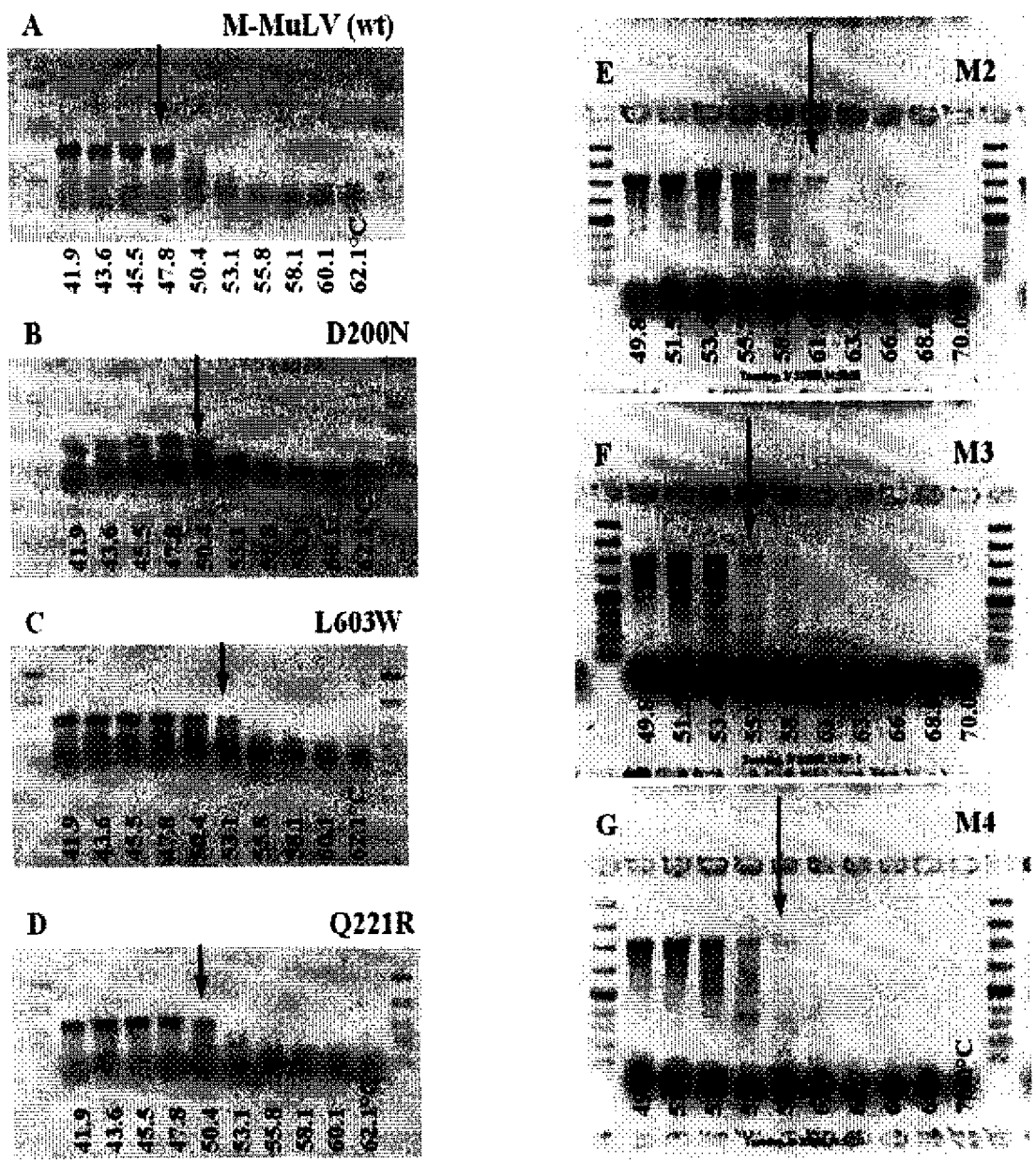

FIG. 16. Some examples of alkaline agarose gels used to determine highest temperature of 1 kb and 4.5 kb cDNA synthesis reaction. PCR machine—Eppendor Mastercycle Gradient. A-D—1 kb cDNA synthesis (M-MuLV (wt), D200N, L603W and Q221R); temperature gradient 41.9° C., 43.6° C., 45.5° C., 47.8° C., 50.4° C., 53.1° C., 55.8° C., 58.1° C., 60.1° C., 62.1° C.; size standart—DNA Fast Ruler Middle Range (Fermentas). E-G—4.5 kb cDNA synthesis (M2, M3 and M4); temperature gradient 49.8° C., 51.5° C., 53.4° C., 55.7° C., 58.3° C., 61.0° C., 63.7° C., 66.1° C., 68.0° C., 70.0° C.; size standart—Zip Ruler Express DNA ladder 2 (Fermentas).

Appendix 1. The general scheme of mutations found in initial MLV RT library (sequence between NcoI and EcoRI restriction sites—SEQ ID No. 24). 23 nucleotide mutations were found among 10 sequenced genes (1 transversion, 20 transitions—mutated positions are underlined, mutations indicated above the sequence, 2 deletions—underlined and indicated as dashed line above the sequence) giving 15 amino acids exchanges, 6 silent mutations, 1 stop codon and 2 frame shifts of coding frame—on average 1-2 amino acids substitutions per gene.

Appendix 2. The CLUSTALW alignment of all 104 protein sequences without N terminal His tag in order to have the same numeration of amino acids as is usually used in literature. Wild type sequence denoted as MLV (SEQ ID No: 25) is always given as first sequence (mutated sequences represent SEQ ID Nos: 26 to 128 based on the order in which they are shown). Mutations are marked using white font color in black background. Amino acids positions, mutations of which somehow improve M-MuLV reverse transcriptase properties and are described in different patent applications are marked in the alignment as columns of amino acids (white font) highlighted in grey. Mutations originating from our selection and located in grey columns indicate that our selection procedure precisely targeted the beneficial hot spot or even exact amino acid mutations described elsewhere. Sequences of analyzed proteins, activity of which at 50° C. was substantially better as compared to the primary wt M-MuLV (70% and more as compared to 45% of wt activity) are highlighted in grey.

Appendix 3. List of mutations found in all selected RT variants. Proteins are sorted by decreasing number of mutations.

Appendix 4. Mutations frequency (in decreasing order) of selected RT variants. Names of analyzed proteins, which activity at 50° C. was substantially better as compared to primary wt M-MuLV (70% and more comparing to 45% of wt activity) are highlighted in grey.

Appendix 5. Summarized table of data on M-MuLV (wt) reverse transcriptase and single mutants, which contains: name of protein; selection frequency (number of sequenced mutants, which had exact mutation and the number in the parentheses indicates total number of particular amino acid mutations found in selection); protein concentration (mg/ml); reverse transcriptase specific activity at 37° C. (u/mg); relative activity at 50° C. (%); relative residual activity at 37° C. after 5 min enzyme incubation at 50° C. (%); specific RNase H activity of protein (u/mol); relative RNase H activity (%) and highest temperature of 1 kb cDNA synthesis reaction.

Appendix 6. Summarized table of data on M-MuLV (wt) reverse transcriptase and single mutants, which contains: name of protein; protein concentration (mg/ml); reverse transcriptase specific activity at 37° C. (u/mg); relative activity at 50° C. (%) and highest temperature of 1 kb and 4.5 kb cDNA synthesis reaction.

Appendix 7. Sequence and information relating to SEQ ID Nos: 1 to 23.

Example 1

CRD—Proof of Principle

To provide proof of principle for Compartmentalized Ribosome Display selection system test selection was performed. Typical proof of principle experiment should give positive signal for active enzyme (in our case RT-PCR fragment for original MLV reverse transcriptase) and no signal for inactive enzyme (no RT-PCR fragment for inactivated MLV reverse transcriptase). More sophisticated experiment is to use mixture of genes with defined ratio encoding active and inactive enzymes. As a result of successful experiment genes encoding active enzyme should be enriched over genes encoding inactive enzyme.

General scheme of experiment is shown in FIG. 1. Two plasmids pET_his_MLV_pD (encoding Moloney Murine Leukemia Virus (M-MLV) reverse transcriptase fused to protein D spacer) and pET_his_del_pD (encoding inactivated (57 amino acids deletion in pol domain) Moloney Murine Leukemia Virus (M-MLV) reverse transcriptase fused to protein D spacer) were used to synthesize PCR fragments. Further PCR fragments were used in transcription reaction for synthesis of mRNA, which lacks STOP codon at the 3' end. Purified mRNAs resulting from the two abovementioned PCR fragments were mixed with a ratio 1:50=MLV (active RT):del (inactive RT) and used for in vitro translation reaction. During translation reaction ribosomal complex synthesizes protein and stops at the end of mRNA lacking STOP codon. Translation reaction was stopped by dilution with ice-cold buffer containing 50 mM $Mg^{2+}$. Low temperature, high concentration of $Mg^{2+}$ ions and absence of STOP codon at the end of mRNA stabilize ternary complexes (TC) of mRNA-ribosome-protein (tRNA). Mixture of ternary complexes (TC) was purified by ultracentrifugation on sucrose cushions. Ultracentrifugation was optimized in such a way that TC (~3.5 MDa) were precipitated at the bottom of ultracentrifugation tube, meanwhile small molecular weight molecules, proteins and most of free mRNA (~0.9 MDa) remained in the supernatant. Precipitated TCs were dissolved in the ice-cold buffer (50 mM $Mg^{2+}$). Purified ternary complexes (<3*$10^9$ molecules taken) already containing mRNA linked to in vitro translated MLV reverse transcriptase were used to prepare reverse transcription reaction mix supplemented with external dNTP set and primer for RT reaction. Ice-cold RT reaction mixture was emulsified yielding ~1'$10^{10}$ water in oil compartments ~2 μm in size. Emulsified RT reaction mixture (less than one TC (mRNA+MLV RT) per compartment was incubated for 1 hr at 42° C. in order to perform RT reaction. After the temperature of compartmentalized RT reaction mixture is raised most of TCs dissociate releasing mRNA and reverse transcriptase. Successful RT reaction is performed only in compartments containing active MLV reverse transcriptase (MLV_pD) and no cDNA is synthesized in compartments with inactive reverse transcriptase (del_pD). Subsequent PCR ensures the amplification of synthesized cDNA and enrichment of active reverse transcriptase (MLV_pD) genes over inactive reverse transcriptase (del_pD) is observed.

Methods and Materials

Initial plasmid pET_his_MLV_pD (SEQ ID No: 1 and FIG. 2) was constructed by modification of pET type plasmid in T7 polymerase promoter and Shine-Dalgarno sequences region and insertion of MLV H+ reverse transcriptase coding sequence (306-2363 on SEQ ID No: 1) with N-terminal His-tag (258-305 on SEQ ID No: 1) and C-terminal fusion with glycine-serine (gs) linker (2364-2393 on SEQ ID No: 1), part of protein D (pD) from phage lambda (2394-2669 on SEQ ID No: 1) and second glycine-serine (gs) linker (2670-2759 on SEQ ID No: 1). N-terminal His-tag is used for protein express purification. C-terminal fusion has to remain in ribosome tunnel during protein in vitro translation and formation of mRNA-ribosome-MLV (tRNA) ternary complex.

M-MuLV reverse transcriptase has two main enzymatic activities: RNA dependent DNA polymerase and RNase H. Reverse transcriptase RNase H activity was turned off introducing point mutation D583N (single nucleotide G to A exchange at position 2055 in plasmid pET_his_MLV_pD, SEQ ID No: 1). Aspartate 583 is located in RNase H active site, is involved in Mg ion binding and is crucial for RNase H activity. New plasmid is identified as pET_his_MLV_D583N_pD and was used for further construction of next plasmid pET_his_del_pD (SEQ ID No: 2), which encodes inactivated reverse transcriptase. Plasmid pET_his_MLV_D583N_pD was digested with restriction endonuclease XmaJI (recognition sequence C↓CTAGG—positions 1047 and 1218 on SEQ ID No: 1). Gene fragment 171 bp in length was removed and digested plasmid was self-ligated, yielding plasmid pET_his_del_pD (SEQ ID No: 2), which encodes reverse transcriptase gene shorter by 171 nucleotides or 57 amino acids, without shift in protein translation frame.

It was important to have the same reverse transcriptase gene: 1) shorter in length (for easy PCR detection); 2) inactive (it was confirmed experimentally that deletion of 57 amino acids in polymerase domain completely inactivated polymerase activity and mutation D583N inactivated RNase H activity); and 3) without frameshift (any frameshift will result in appearance of STOP codons, which are not compatible with ribosome display format).

Preparation of PCR fragments for in vitro transcription. PCR mixture was prepared on ice: 20 μl-10× Taq buffer with KCl (Fermentas); 20 μl-2 mM of each dNTP (Fermentas); 12 μl-25 mM $MgCl_2$ (Fermentas); 16 μl—DMSO (D8418—Sigma); 4 μl-1 u/μl LC (recombinant) Taq DNA Polymerase (Fermentas); 1 μl—100 μM pro-pIVEX primer (SEQ ID No: 3); 1 μl-100 μM pD-ter primer (SEQ ID No: 4); 122 μl water-mixture divided into two tubes 2×98 μl. To 2×98 μl of PCR master mix were added either 2 μl of pET_his_MLV_pD (diluted to ~1 ng/μl) or 2 μl of pET_his_del_pD (diluted to ~1 ng/μl). The cycling protocol was: initial denaturation step 3 min at 94° C., 30 cycles (45 sec at 94° C., 45 sec at 53° C., and 2 min at 72° C.) and final elongation 5 min at 72° C. Amplification was ~7000 fold from 2 ng of plasmid (7873 bp) target to ~5 μg (50 ng/μl) of amplified product (2702 bp PCR fragment for pET_his_MLV_pD; 2531 bp-PCR fragment for pET_his_del_pD).

Transcription mixture was prepared: 40 μl-5×T7 transcription buffer (1 M HEPES-KOH pH 7.6; 150 mM Mg acetate; 10 mM spermidin; 0.2 M DTT); 56 μl-25 mM of each NTP (Fermentas); 8 μl-20 u/μl T7 RNA polymerase (Fermentas); 4 μl-40 u/μl RiboLock RNase inhibitor (Fermentas); 52 μl nuclease-free water-mixture divided into two tubes 2×80 μl and add 20 μl-50 ng/μl of MLV_pD (pro-pIVEX//pD-ter) or 20 μl-50 ng/μl of del_pD (pro-pIVEX//pD-ter) PCR mixture. Transcription was performed 3 hr at 37° C.

Both transcription mixtures were diluted to 200 μl with ice-cold nuclease-free water and 200 μl of 6 M LiCl solution were added. Mixtures incubated 30 min at +4° C. and centrifuged for 30 min at +4° C. in cooling centrifuge at max speed (25,000 g). Supernatant was discarded and RNA pellet washed with 500 μl of ice-cold 75% ethanol. Tubes again were centrifuged for 5 min at +4° C. in cooling centrifuge at max speed and supernatant was discarded. RNA pellet was dried for 12 min at room temperature and subsequently resuspended in 200 μl of nuclease-free ice-cold water by shaking for 15 min at +4° C. and 1400 rpm. Tubes again were centrifuged for 5 min at +4° C. in cooling centrifuge at max speed in order to separate not dissolved RNA. About 180 μl of supernatant were moved to new tube with 20 μl of 10× DNase I buffer ($Mg^{2+}$) (Fermentas); 1-1 u/μl DNaseI (RNase-free) (Fermentas) and incubated for 20 min at +37° C. in order to degrade DNA. To each tube were added 20 μl of 3 M Sodium acetate pH 5.0 solution and 500 μl of ice-cold 96% ethanol. Finally RNA was precipitated by incubation for 30 min at −20° C. and centrifugation for 30 min at +4° C. in cooling centrifuge at max speed (25,000 g). Supernatant was discarded and RNA pellet washed with 500 μl of ice-cold 75% ethanol. Tubes again were centrifuged for 5 min at +4° C. in cooling centrifuge at max speed and supernatant was discarded. RNA pellet was dried for 12 min at room temperature and subsequently resuspended in 43 μl of nuclease-free ice-cold water by shaking for 15 min at +4° C. and 1400 rpm. RNA solution was aliqouted 4×10 μl and liquid nitrogen frozen. Concentration of mRNA was measured spectrophotometrically and double checked on agarose gel using RiboRuler™ RNA Ladder, High Range (Fermentas)—MLV_pD mRNA ~1.2 μg/μl; del_pD mRNA ~1.2 μg/μl.

Purified mRNA is mixed with ratio 1:50=MLV (active RT):del (inactive RT). MLV_pD mRNA was diluted 25 times to ~48 ng/μl and 1 μl (~48 ng) was mixed with 2 μl~1.2 μg/μl del_pD mRNA (2.4 μg) giving mRNA mixture ~0.8 μg/μl with ratio 1:50. In vitro translation was performed using two translation systems RTS100 E. coli HY Kit (03 186 148 001—Roche) and synthetic WakoPURE (295-59503—Wako). Proteins translation sequences are given in SEQ ID No: 6 for MLV_pD and SEQ ID No: 7 for del_pD.

Translation mixture for RTS HY system (25 μl): 6 μl—E. coli lysate (Roche); 5 μl—Reaction Mix (Roche); 6 μl—amino acids (Roche); 0.5 μl-100 mM Met (Roche); 0.5 μl-40 u/□l RiboLock RNase inhibitor (Fermentas); 0.4 μl-200 μM assrA oligonucleotide (SEQ ID No: 5); 0.25 μl-1 M DTT; 2.5 μl reconstitution buffer (Roche); 2.5 μl nuclease-free water and 1.5 μl-0.8 μg/μl mRNA mixture 1:50=MLV_pD:del_pD (~1200 ng). In vitro translation was performed for 20 min at 30° C.

Translation mixture for WakoPURE system (25 μl): 12.5 μl—A solution (Wako); 5 μl—B solution (Wako); 0.5 μl-40 u/□l RiboLock RNase inhibitor (Fermentas); 0.4 μl-200 μM assrA oligonucleotide (SEQ ID No: 6); 0.25 μl-1 M DTT; 5 μl nuclease-free water and 1.5 μl-0.8 μg/μl mRNA mixture 1:50=MLV_pD:del_pD (~1200 ng). In vitro translation was performed for 30 min at 37° C.

Both translations (~25 μl) were stopped by adding 155 μl of ice-cold stopping buffer $WBK_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma)) and centrifuged for 5 min at +4° C. and 25,000 g. Very carefully 160 μl of centrifuged translation mixture was pippeted on the top of 840 μl 35% (w/v) sucrose solution in $WBK_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma); 35% (w/v)—sucrose (84097—Fluka)). In order to purify ternary complexes (TC) of mRNA-ribosome-protein (tRNA) ultra-centrifugation was performed using TL-100 Beckman ultra-centrifuge; TLA100.2 fixed angle rotor (Beckman); transparent 1 ml ultracentrifugation tubes (343778—Beckman) for 9 min at +4° C. and 100,000 rpm. In order to keep small transparent pellet of TC at the bottom of ultracentrifugation tube intact tubes were handled with care. Initially 750 μl of solution was removed from the very top of the centrifugation tube. Then (very carefully) tube walls were washed with 750 μl of $WBK_{500}$ (50 mM tris-acetate pH 7.5 at 25° C.; 50 mM NaCl; 50 mM Mg-acetate; 500 mM KCl). Finally all solution was removed starting from the very top of the centrifugation tube and pellet was dissolved in 30 μl of ice-cold stopping buffer $WBK_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma)).

As it was determined using radioactively labeled mRNA after ultracentrifugation 5%-30% of input mRNA is located in ternary complex pellet. Therefore it was expected to have less than 360 ng (30% from 1200 ng mRNA used in translation reaction) of mRNA in 30 μl of buffer (~12 ng/μl or $9*10^9$ molecules/μl of ternary complex).

Reverse transcription reaction mixture for selection was prepared on ice: 60 μl-5× reaction buffer for Reverse Transcriptase (Fermentas); 7.5 μl-40 u/□l RiboLock RNase inhibitor (Fermentas); 15 μl-20 μM pD_42 oligonucleotide (SEQ ID No: 8); 188 μl nuclease-free water-mixture divided into two tubes 2×135 □l and 0.9 μl of purified (<$8*10^9$ molecules) TC (translation in Roche—RTS HY kit) or 0.9 μl of purified (<$8*10^9$ molecules) TC (translation in Wako—WakoPURE) were added. Each reaction mixture (~135 μl) again was divided into two tubes 45 μl. and 90 μl. To the first part—45 μl of RT mixture 5 μl of nuclease-free water were added. This sample is considered to be the negative selection control (without dNTP) and has to prove that there is no DNA contamination in the reaction mixture and cDNA synthesis is strictly linked to reverse transcriptase functional activity coming from MLV RT in ternary complex. To the second part—90 μl of RT mixture 10 μl-10 mM each dNTP Mix (Fermentas) were added and reaction mixture again was divided into two tubes—50 μl for selection control and 50 μl supplemented with 1 μl-200 u/μl of RevertAid H-M-MuLV Reverse Transcriptase (Fermentas) for positive selection control. According to the protocol each reverse transcription reaction mix contains <$2.7*10^9$ molecules of ternary complex in 50 μl volume.

Oil-surfactant mixture for emulsification was prepared by mixing ABIL EM 90 (Goldschmidt) into mineral oil (M5904—Sigma) to final concentration of 4% (v/v) (Ghadessy and Holliger, 2004; US2005064460). Emulsions were prepared at +4° C. in 5 ml cryogenic vials (430492—Corning) by mixing 950 μl of oil-surfactant mixture with 50 μl of RT mixture. Mixing was performed using MS-3000 magnetic stirrer with speed control (Biosan) at ~2100 rpm; Rotilabo®—(3×8 mm) magnetic followers with center ring (1489.2—Roth); water phase was added by 10 μl aliquots every 30 sec, continuing mixing for 2 more minutes (total mixing time—4 min). According to optical microscopy data compartments in our emulsions vary from 0.5 μm to 10 μm in size with average diameter of ~2 μM. Therefore it was expected to have ~$1'10^{10}$ water in oil compartments after the emulsification of 50 μl reverse transcription reaction mixture, which contains less than $2.7*10^9$ molecules of ternary complex (about 1 mRNA and reverse transcriptase molecules per 3-4 compartments).

All six emulsions representing RT reactions with TC, translation in Roche—RTS HY kit (negative selection control, selection control and positive selection control) and with TC, translation in Wako—WakoPURE (negative selection control, selection control and positive selection control) were incubated 1 hr at +42° C.

To recover the reaction mixtures emulsions were moved to 1.5 ml tube, centrifuged for 1-min at room temperature and 25,000 g. Oil phase was removed leaving concentrated (but still intact) emulsion at the bottom of the tube and 250 µl of PB buffer (Qiagen PCR purification kit) were added. Finally emulsions were broken by extraction with 0.9 ml water-saturated ether; 0.9 ml water-saturated ethyl-acetate (in order to remove ABIL EM 90 detergent) and again 0.9 ml water-saturated ether. Water phase was dried for 5 min under vacuum at room temperature. Synthesized cDNA was purified with Qiagen PCR purification kit and eluted in 30 µl of EB buffer (Qiagen PCR purification kit).

Amplification of cDNA was performed by nested PCR. Initial PCR mixture was prepared on ice: 16 µl-10× Taq buffer with KCl (Fermentas); 16 µl-2 mM of each dNTP (Fermentas); 9.6 µl-25 mM $MgCl_2$ (Fermentas); 3.2 µl-1 u/µl LC (recombinant) Taq DNA Polymerase (Fermentas); 0.8 µl-100 µM RD_Nde primer (SEQ ID No: 9); 0.8 µl-100 µM pD_55 primer (SEQ ID No: 10); 74 µl water-mixture was divided into 6 samples×15 µl (6×15 µl) and 30 µl. To 6×15 µl of PCR master mix were added 5 µl of cDNA (1-6 RT samples); to 30 µl of PCR master mix were added 9 µl water and mixture again divided into two tubes 2×19.5 µl for negative PCR control (plus 0.5 µl water) and positive PCR control (plus 0.5 µl-1:1 mixture (~1 ng) of pET_his_MLV_pD and pET_his_del_pD plasmids). The cycling protocol was: initial denaturation step 3 min at 94° C., 25 cycles (45 sec at 94° C., 45 sec at 58° C., and 2 min at 72° C.) and final elongation 5 min at 72° C. Expected length of PCR fragments was 2185 bp for MLV_pD and 2014 bp for del_pD. Amplification was analyzed on 1% agarose gel loading 10 µl of PCR mix per well (FIG. 3).

Nested PCR was performed using two different sets of primers, giving either partial gene amplification (for better resolution of MLV:del cDNA ratio in RT samples) or full gene amplification (to prove possibility of full gene recovery).

Nested PCR mixture for partial gene amplification was prepared on ice: 28 µl-10× Taq buffer with KCl (Fermentas); 28 µl-2 mM of each dNTP (Fermentas); 16.8 µl-25 mM $MgCl_2$ (Fermentas); 5.6 µl-1 u/µl LC (recombinant) Taq DNA Polymerase (Fermentas); 1.4 µl-100 µM M_F primer (SEQ ID No: 11); 1.4 µl-100 µM M_2R primer (SEQ ID No: 12); 185 µl water-mixture divided 2×19 µl and 6×38 µl. To 2×19 µl of PCR master mix was added 1 µl of positive or negative controls of first PCR (primers set RD_Nde//pD_55)-30 PCR cycles amplification; to 6×38 µl of PCR master mix were added 2 µl of first PCR (primers set RD_Nde//pD_55) (1-6 samples)—each sample again was divided into two 2×20 µl for 23 or 30 PCR cycles amplification. The cycling protocol was: initial denaturation step 3 min at 94° C., 23 or 30 cycles (45 sec at 94° C., 45 sec at 57° C., and 1 min at 72° C.) and final elongation 5 min at 72° C. Expected length of PCR fragments was 907 bp for MLV_pD and 736 bp for del_pD. Amplification was analyzed on 1% agarose gel loading 10 µl of PCR mix per well (FIG. 4).

Nested PCR mixture for full gene amplification was prepared on ice: 28 µl-10× Taq buffer with KCl (Fermentas); 28 µl-2 mM of each dNTP (Fermentas); 16.8 µl-25 mM $MgCl_2$ (Fermentas); 5.6 µl-1 u/µl LC (recombinant) Taq DNA Polymerase (Fermentas); 1.4 µl-100 µM M_Esp primer (SEQ ID No: 13); 1.4 µl-100 µM M_Eri primer (SEQ ID No: 14); 185 µl water-mixture divided 2×19 µl and 6×38 W. To 2×19 µl of PCR master mix was added 1 µl of positive or negative controls of first PCR (primers set RD_Nde//pD_55)-30 PCR cycles amplification; to 6×38 µl of PCR master mix were added 2 µl of first PCR (primers set RD_Nde//pD_55) (1-6 samples)—each sample again was divided into 2×20 µl for 23 or 30 PCR cycles amplification. The cycling-protocol was: initial denaturation step 3 min at 94° C., 23 or 30 cycles (45 sec at 94° C., 45 sec at 55° C., and 2 min at 72° C.) and final elongation 5 min at 72° C. Expected length of PCR fragments was 2077 bp for MLV_pD and 1906 bp for del_pD. Amplification was analyzed on 1% agarose gel loading 10 µl of PCR mix per well (FIG. 5).

Results

To demonstrate proof of principle for Compartmentalized Ribosome Display (CRD) method selection was performed using starting 1:50=MLV:del mixture of two mRNA encoding active (MLV) and inactive (del) reverse transcriptases fused to protein D spacer (FIG. 1). In vitro translation was performed using two different translation systems Roche—RTS 100 E. coli HY or Wako—WakoPURE in order to understand which translation system is better in our experimental setup. For each translation system three compartmentalized RT reactions were performed: negative selection control without dNTP, which has to prove that there is no DNA contamination in the reaction mixture; selection control, which has to demonstrate the enrichment of genes encoding active (MLV) reverse transcriptase over genes encoding inactivated enzyme (del), because only active enzyme can synthesize cDNA; and positive selection control supplemented with external RevertAid H-commercial reverse transcriptase, which has to serve as positive RT control synthesizing cDNA from both MLV_pD and del_pD mRNA in all compartments, showing real ratio of genes in reaction mixture without selection pressure applied.

Synthesyzed cDNA was amplified by nested PCR. The picture of agarose gel electrophoresis of initial PCR (25 cycles) (FIG. 3) shows weak PCR fragments bands only in case of both positive selection controls (translation systems—Roche and Wako). This is normal, because these samples contain external RT enzyme, which synthesizes cDNA much more efficiently comparing to reactions containing only one in vitro synthesized reverse transcriptase molecule per compartment.

The picture of agarose gel electrophoresis of nested PCR (partial gene amplification) is shown in FIG. 4. Amplification results after 23 and 30 PCR cycles are consistent:
1) there is no amplification (no DNA contamination) in negative selection controls (w/o dNTP);
2) very efficient amplification of delpD cDNA (736 bp DNA fragment) is observed in positive selection controls (external RT enzyme) and no MLV_pD cDNA amplification is visible, because initial ratio of MLV_pD to del_pD mRNA is 1:50;
3) amplification of both cDNA MLV_pD (907 bp DNA fragment) and del_pD (736 bp DNA fragment) are observed in case of selection controls;
4) ratio of MLV_pD:del_pD~1:1 is observed in case of reverse transcriptase synthesized by Roche in vitro translation system, what means ~50 times enrichment of MLV_pD genes over del_pD genes starting from initial 1:50 ratio;
5) ratio of MLV_pD:del_pD~1:3 is observed in case of reverse transcriptase synthesized by Wako in vitro translation system, what means ~16 times enrichment of MLV_pD genes over del_pD genes starting from initial 1:50 ratio.

The picture of agarose gel electrophoresis of nested PCR (full gene amplification) is shown in FIG. 5. Amplification results after 23 and 30 PCR cycles are consistent in between and comparing to results of nested PCR used for partial gene amplification (FIG. 5):
1) there is no amplification (no DNA contamination) in negative selection controls (w/o dNTP);
2) very efficient amplification of del_pD cDNA (1906 bp DNA fragment) is observed in positive selection controls (external RT enzyme) and no MLV_pD cDNA amplification is visible, because initial ratio of MLV_pD to del_pD mRNA is 1:50;
3) amplification of both cDNA MLV_pD (2077 bp DNA fragment) and del_pD 1906 bp DNA fragment) are observed in case of selection controls;
4) it is difficult to determine ratio of MLV_pD:del_pD in case of full gene amplification, because relative difference between 2077 bp (MLV_pD) and 1906 bp (del_pD) DNA fragments is not big enough, but in general ratios are similar to results of nested PCR used for partial gene amplification.

As a result of this example we can conclude that during reverse transcription reaction performed in CRD format we have enriched genes encoding active MLV reverse transcriptase over the genes encoding inactive enzyme by a factor of 50 in case of Roche translation system or by a factor of 16 in case of Wako translation system used to synthesize enzymes in vitro.

Example 2

CRD—Selection for Reverse Transcriptase, which Shows Improved Performance at Higher Temperatures In order to understand, how efficiently Compartmentalized Ribosome Display (CRD) selection works, evolution experiment of Moloney Murine Leukemia Virus reverse transcriptase (M-MuLV RT) was performed. General scheme of experiment is shown in FIG. 6. Initial mutants library of reverse transcriptase was constructed by error-prone PCR using nucleotide analogues dPTP and 8-oxo-dGTP. Whole gene (~2 kb) mutagenesis was performed introducing 2-3 nucleotides or 1-2 amino acids mutations per gene. PCR fragment encoding mutants library of reverse transcriptase (in fusion with protein D) MLV_pD was used to synthesize mRNA. Purified mRNA was used for in vitro translation reaction. Ternary complexes (TC) of mRNA-ribosome-MLV_pD (tRNA) were formed in translation mixture and stabilized by low temperature and high concentration of $Mg^{2+}$ ions. Mixture of TC was purified by ultracentrifugation on sucrose cushions. Precipitated TC was dissolved in ice-cold buffer (50 mM $Mg^{2+}$) and used to prepare reverse transcription reaction mix supplemented with external dNTP set and primer for RT reaction. Ice-cold RT reaction mixture was emulsified giving ~1*$10^{10}$ water in oil compartments ~2 μm in size. Optimal reaction temperature of MLV RT is ~42° C. In order to select for reverse transcriptase variants, which are working better at higher temperatures emulsified RT reaction mixture (less than one TC (mRNA+MLV RT) per compartment) was incubated for 1 hr at 50° C. At this temperature successful synthesis of full length cDNA was performed better in compartments containing more active or thermostable MLV reverse transcriptase variants. Subsequent PCR was used to amplify full length cDNA and enrichment for more active and thermostable reverse transcriptase genes was performed. By PCR amplified genes were moved back to CRD format restoring intact 5' (START fragment—T7 polymerase promoter, SD and his-tag coding sequences) and 3' (END fragment—gs linker, protein D and second gs linker) sequences by ligation-PCR.

Reconstructed PCR fragment, containing enriched library of reverse transcriptase genes, was used for subsequent mRNA transcription and next CRD selection round. Each selection round was performed at higher and higher temperatures of RT reaction: 50° C. ($1^{st}$ round); 52.5° C. ($2^{nd}$ round); 55° C. ($3^{rd}$ round); 57.5° C. ($4^{th}$ round) and 60° C. ($5^{th}$ round).

Amplified library of reverse transcriptase genes (without C terminal pD linker) after $5^{th}$ selection round was cloned into plasmid vector. Individual clones were sequenced and analyzed. Pool of evolved proteins as well as individual mutants were purified via his-tag using affinity chromatography. MLV reverse transcriptase specific activities at 37° C., 50° C. and residual activity at 37° C. after 5 min enzyme incubation at 50° C. were determined.

Methods and Materials

Initial plasmid pET_his_MLV_pD (SEQ ID No: 1 and FIG. 2) was used as a starting material for error-prone PCR. Mutations were introduced using nucleotide analogues dPTP and 8-oxo-dGTP. PCR mixture for error prone PCR was prepared on ice: 10 μl-10× Taq buffer with KCl (Fermentas); 10 μl-2 mM of each dNTP (Fermentas); 6 μl-25 mM $MgCl_2$ (Fermentas); 2 μl-1 u/μl LC (recombinant) Taq DNA Polymerase (Fermentas); 0.5 μl-100 μM M_Esp primer (SEQ ID No: 13); 0.5 μl-100 μl M_Eri primer (SEQ ID No: 14); 1-10 μM dPTP (TriLink BioTechnolgies); 5 μl-100 μM 8-oxo-dGTP (TriLink BioTechnolgies); 3.75 μl-40 ng/μl (totally 150 ng) of pET_his_MLV_pD plasmid; 61.25 μl water. The cycling protocol was: initial denaturation step 3 min at 94° C., 30 cycles (30 sec at 94° C., 30 sec at 55° C., and 2 min at 72° C.) and final elongation 5 min at 72° C. Amplification was 150-300 fold from 150 ng of plasmid (7873 bp) target to ~6-12 μg of amplified product (2077 bp PCR fragment for pET_his_MLV_pD). PCR fragment was purified using Qiagen PCR purification kit, digested with Esp3I (recognition sequence CGTCTC (1/5)) and EcoRI (recognition sequence G↓AATTC) and finally purified from agarose gel using Qiagen Gel extraction kit giving DNA concentration ~50 ng/μl.

Mutagenesis efficiency and library quality was checked by sequencing of individual clones subcloned back into original pET_his_MLV_pD plasmid digested with NcoI and EcoRI. As it was expected mutations were distributed randomly all over the amplified sequence of MLV RT gene (Appendix 1). Among 10 sequenced genes 23 nucleotide mutations (1 transversion, 20 transitions, 2 deletions—labelled red in Appendix 1) were found giving 15 amino acids exchanges, 6 silent mutations, 1 stop codon and 2 frame shifts of coding frame—on average 1-2 amino acids substitutions per gene.

Mutated library was ligated with START (244 bp) and END (398 bp) fragments in order to get PCR fragment suitable for CRD selection (FIG. 7). START fragment (containing T7 polymerase promoter, SD and his-tag coding sequences) was constructed by PCR amplification of initial 983 bp START fragment (target—plasmid pET_his_del_pD (SEQ ID No: 2), primers—pro-pIVEX (SEQ ID No: 3) and M_1R (SEQ ID No: 15)) and subsequent digestion with NcoI (recognition sequence C↓CATGG) giving 244 bp DNA fragment. END fragment (containing gs linker, protein D and second gs linker sequences) was constructed by PCR amplification of initial 1039 bp END fragment (target—plasmid pET_his_del_pD (SEQ ID No: 2), primers—M_3F (SEQ ID No: 16) and pD-ter (SEQ ID No: 4)) and subsequent digestion with EcoRI (recognition sequence G↓AATTC) giving 398 bp DNA fragment.

Ligation reaction (150 μl) was prepared at room temperature: 15 μl-10× ligation buffer for T4 DNA Ligase (Fermentas); 15 μl-1 u/μl T4 DNA ligase (Fermentas); 26 μl-50 ng/μl mutated MLV RT library digested with Esp3I (NcoI compatible end) and EcoRI (~1300 ng or ~5.9*10$^{11}$ molecules); 9.4 μl-35 ng/μl START fragment digested with NcoI (~329 ng or ~1.2*10$^{12}$ molecules); 15.7 μl-35 ng/μl END fragment digested with EcoRI (~548 ng or ~1.2*10$^{12}$ molecules); 68.9 μl-water. Ligation was performed overnight at +4° C. Reaction mixture was treated once with phenol and twice with chloroform, precipitated and dissolved in 53 μl of water. Approximate ligation yield ~20% was determined comparing amplification efficiency of ligation mixture and known amount of plasmid pET_his_MLV_pD. Taking into account 20% ligation yield diversity of MLV RT mutants library was defined as ~1.2*10$^{11}$ molecules (50 μl).

Ligated MLV RT library was amplified by PCR (1 ml—prepared on ice): 100 μl-10× Taq buffer with KCl (Fermentas); 100 μl-2 mM of each dNTP (Fermentas); 60 μl-25 mM MgCl$_2$ (Fermentas); 80 μl—DMSO (08418—Sigma); 20 μl-1 u/μl LC (recombinant) Taq DNA Polymerase (Fermentas); 5 μl-100 μM pro-pIVEX primer (SEQ ID No: 3); 5 μl-100 μM pD-ter—primer (SEQ ID No: 17); 20 μl—ligated MLV RT library (~5*10$^{10}$ molecules); 610 μl—water. The cycling protocol was: initial denaturation step 3 min at 94° C., 15 cycles (30 sec at 94° C., 30 sec at 53° C., and 3 min at 72° C.) and final elongation 5 min at 72° C. Amplification was ~200 fold from ~5*10$^{10}$ molecules (corresponds to ~150 ng) of final ligation fragment 2702 bp in size target to ~30 μg (30 ng/μl) of amplified product (2702 bp PCR fragment).

1$^{st}$ Selection Round

Transcription mixture (100 μl) was prepared: 20 μl-5×T7 transcription buffer (1 M HEPES-KOH pH 7.6; 150 mM Mg acetate; 10 mM spermidin; 0.2 M DTT); 28 μl-25 mM of each NTP (Fermentas); 4 μl-20 u/μl T7 RNA polymerase-(Fermentas); 2 μl-40 u/μl RiboLock RNase inhibitor (Fermentas); 30 μl-30 ng/μl of mutants library (pro-pIVEX//pD-ter-) PCR mixture (~900 ng or ~3*10$^{11}$ molecules); 16 μl nuclease-free water. Transcription was performed 3 hr at 37° C. (library diversity ~5*10$^{10}$ molecules).

Transcription mixture was diluted to 200 μl with ice-cold nuclease-free water and 200 μl of 6 M LiCl solution were added. Mixture incubated 30 min at +4° C. and centrifuged for 30 min at +4° C. in cooling centrifuge at max speed (25,000 g). Supernatant was discarded and RNA pellet washed with 500 μl of ice-cold 75% ethanol. Tube again was centrifuged for 5 min at +4° C. in cooling centrifuge at max speed and supernatant was discarded. RNA pellet was dried for 12 min at room temperature and subsequently resuspended in 200 μl of nuclease-free ice-cold water by shaking for 15 min at +4° C. and 1400 rpm. Tube again was centrifuged for 5 min at +4° C. in cooling centrifuge at max speed in order to separate not dissolved RNA. About 180 μl of supernatant were moved to new tube with 20 μl of 10× DNase I buffer (Mg$^{2+}$) (Fermentas); 1-1 u/μl DNaseI (RNase-free) (Fermentas) and incubated for 30 min at +37° C. in order to degrade DNA. To reaction mixture were added 20 μl of 3 M Sodium acetate pH 5.0 solution and 500 μl of ice-cold 96% ethanol. Finally RNA was precipitated by incubation for 30 min at −20° C. and centrifugation for 30 min at +4° C. in cooling centrifuge at max speed (25,000 g). Supernatant was discarded and RNA pellet washed with 500 μl of ice-cold 75% ethanol. Tube again was centrifuged for 5 min at +4° C. in cooling centrifuge at max speed and supernatant was discarded. RNA pellet was dried for 12 min at room temperature and subsequently resuspended in 33 μl of nuclease-free ice-cold water by shaking for 10 min at +4° C. and 1400 rpm. RNA solution was aliqouted 3×10 μl and liquid nitrogen frozen. Concentration of mRNA was measured spectrophotometrically and double checked on agarose gel using RiboRuler™ RNA Ladder, High Range (Fermentas)-MLV RT library mRNA ~2.1 μg/μl.

In vitro translation was performed using RTS 100 E. coli HY (03 186 148 001—Roche) translation system (25 μl): 6 μl—E. coli lysate (Roche); 5 μl—Reaction Mix (Roche); 6 μl—amino acids (Roche); 0.5 μl-100 mM Met (Roche); 0.5 μl-40 u/1:11 RiboLock RNase inhibitor (Fermentas); 0.4 μl-200 μM assrA oligonucleotide (SEQ ID No: 5); 0.25 μl-1 M DTT; 3 μl reconstitution buffer (Roche); 2.5 μl nuclease-free water and 0.6 μl-2.1 μg/μl mRNA (~1200 ng). Reaction mixture was incubated for 20 min at 30° C. Translation was stopped adding 155 μl of ice-cold stopping buffer WBK$_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma)) and centrifuged for 5 min at +4° C. and 25,000 g. Very carefully 160 μl of centrifuged translation mixture was pippeted on the top of 840 μl 35% (w/v) sucrose solution in WBK$_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma); 35% (w/v)—sucrose (84097—Fluke)). In order to purify ternary complexes (TC) of mRNA-ribosome-MLV (tRNA) ultracentrifugation was performed using TL-100 Beckman ultracentrifuge; TLA100.2 fixed angle rotor (Beckman); transparent 1 ml ultracentrifugation tubes (343778—Beckman) for 9 min at +4° C. and 100,000 rpm. In order to keep small transparent pellet of TC at the bottom of ultracentrifugation tube intact tubes were handled with care. Initially 750 μl of solution was removed from the very top of the centrifugation tube. Than (very carefully) tube walls were washed with 750 μl of WBK$_{500}$ (50 mM tris-acetate pH 7.5 at 25° C.; 50 mM NaCl; 50 mM Mg-acetate; 500 mM KCl). Finally all solution was removed starting from the very top of the centrifugation tube and pellet was dissolved in 30 μl of ice-cold stopping buffer WBK$_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma)).

As it was determined experimentally, using radioactively labeled mRNA, ultracentrifugation yields 5%-30% of input mRNA in ternary complex pellet. Therefore it was expected to have less than 360 ng (30% from 1200 ng mRNA used in translation reaction) of mRNA in 30 μl of buffer (~12 ng/μl or 9*10$^9$ molecules/μl of ternary complex).

Reverse transcription reaction mixture for selection was prepared on ice: 60 μl-5× reaction buffer for Reverse Transcriptase (Fermentas); 7.5 μl-40 u/μl RiboLock RNase inhibitor (Fermentas); 15 μl-20 μM pD_42 oligonucleotide (SEQ ID No: 8); 186 μl nuclease-free water and 1.8 μl of purified (<1.8*10$^{10}$ molecules) TC (translation in Roche—RTS HY kit). Reaction mixture was divided into two tubes 45 μl and 225 μl. To first part—45 μl of RT mixture were added 5 μl of nuclease-free water. This sample was considered to be negative selection control (without dNTP) and has to prove that there is no DNA contamination in the reaction mixture and cDNA synthesis is strictly linked to reverse transcriptase functional activity coming from MLV RT in ternary complex. To second part—225 μl of RT mixture were added 25 μl-10 mM each dNTP Mix (Fermentas) and reaction mixture again was divided into two tubes ~200 μl (4×50 μl) for selection control (<1.2*10$^{10}$ molecules of TC totally) and 50 μl supplemented with 1 μl-200 u/μl of RevertAid H-M-MuLV Reverse Transcriptase (Fermentas) for positive selection control.

According to protocol each reverse transcription reaction mix contains <3*10⁹ molecules of ternary complex in 50 µl volume.

Oil-surfactant mixture for emulsification was prepared by mixing ABIL EM 90 (Goldschmidt) into mineral oil (M5904—Sigma) to final concentration of 4% (v/v) (Ghadessy and Holliger, 2004; US2005064460). Emulsions were prepared at +4° C. in 5 ml cryogenic vials (430492—Corning) by mixing 950 µl of oil-surfactant mixture with 50 µl of RT mixture. Mixing was performed using MS-3000 magnetic stirrer with speed control (Biosan) at ~2100 rpm; Rotilabo®—(3×8 mm) magnetic followers with centre ring (1489.2—Roth); water phase was added by 10 µl aliquots every 30 sec, continuing mixing for 2 more minutes (total mixing time—4 min). According to optical microscopy data compartments in our emulsions vary from 0.5 µm to 10 µm in size with average diameter of ~2 µm. Therefore it was expected to have ~1'10$^{10}$ water in oil compartments after the emulsification of 50 µl reverse transcription reaction mixture, which contains less than 3*10$^9$ molecules of ternary complex (about 1 mRNA and reverse transcriptase molecules per 3-4 compartments).

All emulsions were incubated 1 hr at +50° C. in order to select for reverse transcriptase variants, which work better at higher temperatures. To recover the reaction mixtures emulsions were moved to 1.5 ml tube, centrifuged for 10 min at room temperature and 25,000 g. Oil phase was removed leaving concentrated (but still intact) emulsion at the bottom of the tube. Emulsions were broken by extraction with 0.9 ml water-saturated ether, 0.9 ml water-saturated ethyl-acetate (in order to remove ABIL EM 90 detergent) and again 0.9 ml water-saturated ether. Water phase was dried for 5 min under vacuum at room temperature and 250 µl of PB buffer (Qiagen PCR purification kit) were added. Four selection samples were merged into two tubes. Synthesized cDNA was further purified with Qiagen PCR purification kit and eluted in 30 µl of EB buffer (Qiagen PCR purification kit) in case of negative and positive selection controls and 2×30 µl in case of selection control.

Amplification of cDNA was performed by nested PCR. First of all small PCR amplification was performed in order to check negative and positive selection controls and determine minimal number of PCR cycles required for efficient amplification of cDNA in selection samples. PCR mixture (200 µl) was prepared on ice: 20 µl-10× Taq buffer with KCl (Fermentas); 20 µl-2 mM of each dNTP (Fermentas); 12 µl-25 mM MgCl$_2$ (Fermentas); 2.5 µl-1 u/µl LC (recombinant) Taq DNA Polymerase (Fermentas); 1-2.5 u/µl Pfu DNA Polymerase (Fermentas); 1-100 µM RD_Nde primer (SEQ ID No: 9); 1 µl-100 µM pD__55 primer (SEQ ID No: 10); 50 µl—purified cDNA of selection controls; 92 µl water. The cycling protocol for 2185 bp PCR fragment was: initial denaturation step 3 min at 94° C., 25 cycles (45 sec at 94° C., 45 sec at 58° C., and 2 min at 72° C.) and final elongation 5 min at 72° C.

Nested PCR mixture (500 µl) for full gene amplification was prepared on ice: 50 µl-10× Taq buffer with KCl (Fermentas); 50 µl-2 mM of each dNTP (Fermentas); 30 µl-25 mM MgCl$_2$ (Fermentas); 6.25 µl-1 u/µl LC (recombinant) Taq DNA Polymerase (Fermentas); 2.5 µl-2:5 u/µl Pfu DNA Polymerase (Fermentas); 2.5 µl-100 µM M_Esp primer (SEQ ID No: 13); 2.5 µl-100 µM M_Eri primer (SEQ ID No: 14); 50 µl of first PCR (primers-set RD_Nde//pD__55); 306 µl water. The cycling protocol for 2077 bp PCR fragment was: initial denaturation step 3 min at 94° C., 22 cycles (45 sec at 94° C., 45 sec at 55° C., and 2 min at 72° C.) and final elongation 5 min at 72° C.

Final PCR fragment of selection sample was agarose-gel purified using Qiagen gel extraction kit (elution in 60 µl~50 ng/µl). Purified PCR fragment was digested with EcoRI and Esp3I for 1 hr at 37° C. and again agarose-gel purified (elution in 30 µl~50 ng/µl).

Recovered MLV reverse transcriptase library after 1$^{st}$ selection round was ligated with START and END fragments (construction described earlier in this example) in order to get PCR fragment (FIG. 7) suitable for 2$^{nd}$ round of CRD selection (FIG. 6). Ligation reaction (40 µl) was prepared at room temperature: 4 µl-10× ligation buffer for T4 DNA Ligase (Fermentas); 2 µl-1 u/µl T4 DNA ligase (Fermentas); 4 µl-50 ng/µl selected library digested with Esp3I and EcoRI (~200 ng or ~0.9*10$^{11}$ molecules); 1.1 µl-35 ng/µl START fragment digested with NcoI (~35 ng or ~1.5*10$^{11}$ molecules); 1.76 µl-35 ng/µl END fragment digested with EcoRI (~61 ng or ~1.5*10$^{11}$ molecules); 27.2 µl-water. Ligation was performed 1 hr at room temperature.

Ligated MLV RT library was amplified by PCR (300 µl—prepared on ice): 30 µl-10× Taq buffer with KCl (Fermentas); 30 µl-2 mM of each dNTP (Fermentas); 18 µl-25 mM MgCl$_2$ (Fermentas); 24 µl—DMSO (D8418—Sigma); 3.7 µl-1 u/µl LC (recombinant) Taq DNA Polymerase (Fermentas); 1.5 µl-2.5 u/µl Pfu DNA Polymerase (Fermentas); 1.5 µl-100 µM pro-pIVEX primer (SEQ ID No: 3); 1.5 µl-100 µM pD-ter-primer (SEQ ID No: 17); 25.5 µl—ligated MLV RT library (<0.6*10$^{10}$ molecules); 164.3 µl-water. The cycling protocol for 2702 bp PCR fragment was: initial denaturation step 3 min at 94° C., 15 cycles (45 sec at 94° C., 45 sec at 53° C., and 3 min at 72° C.) and final elongation 5 min at 72° C. PCR fragment was agarose-gel purified using Qiagen gel exraction kit (elution in 30 µl~100 ng/µl).

2$^{nd}$ Selection Round

Second selection round was performed following general setup of 1° selection round of experimental scheme with minor modifications in PCR cycles, emulsified RT reaction temperature and few more details.

All modifications are given below:
transcription—10 µl-100 ng/µl (~1000 ng) of agarose-gel purified PCR fragment were taken; final concentration of mRNA used in 2$^{nd}$ selection round was 1.5 µg/µl;
translation—0.8 µl (~1.2 µg) of mRNA were taken;
emulsified RT reaction was performed 1 hr at 52.5° C.;
1$^{st}$ PCR (RD_Nde//pD__55)—24 cycles were performed;
2$^{nd}$ (nested) PCR (M_Esp//M_Eri)—23 cycles were performed;
final concentration of digested PCR fragment—80 ng/µl;
ligation—200 ng (~0.9*10$^{11}$ molecules) of MLV RT library were taken;
PCR (on ligation mix)—<0.6*10$^{10}$ molecules of selected library were taken and 15 PCR cycles were performed; concentration of final agarose-gel purified PCR fragment was 200 ng/µl.

3$^{rd}$ Selection Round

Third selection round was performed following general setup of 1$^{st}$ selection round of experimental scheme with minor modifications in PCR cycles, emulsified RT reaction temperature and few more details.

All modifications are given below:
transcription—5 µl-200 ng/µl (~1000 ng) of agarose-gel purified PCR fragment were taken; final concentration of mRNA used in 3$^{rd}$ selection round was 1.5 µg/µl;
translation—0.8 µl-1.5 µg/µl (~1.2 µg) of mRNA were taken;
emulsified RT reaction was performed 1 hr at 55° C.;
1$^{st}$ PCR (RD_Nde//pD__55)—25 cycles were performed;

2nd (nested) PCR (M_Esp//M_Eri)—22 cycles were performed;

final concentration of digested PCR fragment—70 ng/μl;

ligation—200 ng (~0.9*10^11 molecules) of MLV RT library were taken;

PCR (on ligation mix)—<0.6*10^10 molecules of selected library were taken and 15 PCR cycles were performed; concentration of final agarose-gel purified PCR fragment was 100 ng/μl.

4th Selection Round

Fourth selection round was performed following general setup of 1st selection round of experimental scheme with minor modifications in PCR cycles, emulsified RT reaction temperature and few more details.

All modifications are given bellow:

transcription—10 μl-100 ng/μl (~1000 ng) of agarose-gel purified PCR fragment were taken; final concentration of mRNA used in 4th selection round was 1.8 μg/μl;

translation—0.67 μl-1.8 μg/μl (~1.2 μg) of mRNA were taken;

emulsified RT reaction was performed 1 hr at 57.5° C.;

1st PCR (RD_Nde//pD_55)—25 cycles were performed;

2nd (nested) PCR (M_Esp//M_Eri)—24 cycles were performed;

final concentration of digested PCR fragment—50 ng/μl;

ligation—200 ng (~0.9*10^11 molecules) of MLV RT library were taken;

PCR (on ligation mix)—<0.6*10^10 molecules of selected library were taken and 15 PCR cycles were performed; concentration of final agarose-gel purified PCR fragment was 100 ng/μl.

5th Selection Round

Fifth selection round was performed following general setup of 1st selection round of experimental scheme with some modifications in PCR cycles, emulsified RT reaction temperature and final stage of analysis.

All modifications are given bellow:

transcription—10 μl-100 ng/μl (~1000 ng) of agarose-gel purified PCR fragment were taken; final concentration of mRNA used in 5th selection round was 1.1 μg/μl;

translation—1.1 μl-1.1 μg/μl (~1.2 μg) of mRNA were taken;

emulsified RT reaction was performed 1 hr at 60° C.;

1st PCR (RD_Nde//pD_55)—25 cycles were performed;

2nd (nested) PCR (M_Esp//M_Eri)—33 cycles were performed;

Nested PCR mixture (500 μl) for full gene amplification was prepared on ice: 50 μl-10× Taq buffer with KCl (Fermentas); 50 μl-2 mM of each dNTP (Fermentas); 30 μl-25 mM MgCl$_2$ (Fermentas); 6.25 μl-1 u/μl LC (recombinant) Taq DNA Polymerase (Fermentas); 2.5 μl-2.5 u/μl Pfu DNA Polymerase (Fermentas); 2.5 μl-100 μM M_Esp primer (SEQ ID No: 13); 2.5 μl-100 μM M_Hind3+ primer (SEQ ID No: 18); 50 μl of first PCR (primers set RD_Nde//pD_55); 306 μl water. The cycling protocol for 2077 bp PCR fragment was: initial denaturation step 3 min at 94° C., 22 cycles (45 sec at 94° C., 45 sec at 55° C., and 3 min at 72° C.) and final elongation 5 min at 72° C.

Final PCR fragment of selection sample was agarose-gel purified using Qiagen gel extraction kit (elution in 60 μl~60 ng/μl). Purified PCR fragment was digested with HindIII and Esp3I for 1 hr at 37° C. and again agarose-gel purified (elution in 40 μl~50 ng/μl).

Recovered MLV reverse transcriptase library after 5th selection round was ligated into plasmid vector prepared from pET_his_MLV_pD (SEQ ID No: 1 and FIG. 2) digested with NcoI and HindIII, giving new 7474 bp plasmid pET_his_MLV (SEQ ID No: 19) encoding MLV RT with N-terminal his-tag and no pD fusion on C-terminus for fast protein purification using affinity chromatography.

Ligated MLV RT library after 5th selection round was electroporated into T7 expression strain ER2566. Individual clones were sequenced and analyzed. Pool of evolved proteins as well as individual mutants and primary wt M-MuLV reverse transcriptase in the same construction were grown in 200 ml of LB to A590 ~0.7 and purified via his-tag by affinity chromatography using 2 ml of Qiagen-Ni-NTA Superflow resin (all purification was performed under native conditions according to suppliers recommendations). Elution was performed in 1 ml of EB (50 mM—NaH$_2$PO$_4$, 300 mM—NaCl, 250 mM—imidazol, pH 8.0, 10 mM—β-mercaptoethanol and 0.1% of triton X-100). All proteins were dialyzed against 50 times excess of storage buffer (50 mM Tris-HCl (pH 8.3 at 25° C.), 0.1 M NaCl, 1 mM EDTA, 5 mM DTT, 0.1% (v/v). Triton X-100 and 50% (v/v) glycerol). Protein purity was checked on SDS-PAGE (usually ~40-80% of target protein). Protein concentration was determined using Bredford method based Bio-Rad protein assay (500-0006).

MLV reverse transcriptase specific activities were measured at 37° C., 50° C. (enzyme diluted in special dilution buffer: 30 mM Tris-HCl pH 8.3 at 25° C., 10 mM DTT, 0.5 mg/ml BSA) and rest of activity at 37° C. after 5 min enzyme incubation at 50° C. (enzyme diluted and its stability measured in 1×RT reaction buffer: 50 mM Tris-HCl pH 8.3 at 25° C., 4 mM MgCl$_2$, 10 mM DU, 50 mM KCl). Enzyme activity in all cases was assayed in the following final mixture: 50 mM Tris-HCl (pH 8.3 at 25° C.), 6 mM MgCl$_2$, 10 mM DTT, 40 mM KCl, 0.5 mM dTTP, 0.4 MBq/ml [3H]-dTTP, 0.4 mM polyA.oligo(dT)$_{12-18}$. Activity units were determined measuring incorporation of dTMP into a polynucleotide fraction (adsorbed on DE-81) in 10 min at particular reaction temperature and comparing to known amounts of commercial enzyme.

Results

During analysis of selection data we have accumulated 104 sequences expressing full length M-MuLV reverse transcriptase. The total CLUSTALW alignment of all proteins (Appendix 2) is compiled without N terminal His tag in order to have the same numeration of amino acids as is usually used in literature. Wild type sequence denoted as MLV is always given as the first sequence. Mutations are marked using white font color in black background (Appendix 2). Amino acids positions, mutations of which somehow improve M-MuLV reverse transcriptase properties and are described in different patent applications are marked in the alignment as columns of amino acids (white font) highlighted in grey. Mutations originating from our selection and located in grey columns serve as proof that our selection procedure precisely targeted the beneficial hot spot or even exact amino acid mutations described elsewhere. Out of 104 sequenced clones we found 98 unique sequences and 1 wt (L5_87) sequence. Five sequences are repeated twice (L5_21 and L5_111; L5_43 and L5_112; L5_49 and L5_63; L5_64 and L5_93; L5_85 and L5_96). In total we had randomly expressed 55 proteins. Out of 55 expressed proteins 40 enzymatically active mutant variants (including control wt) of M-MuLV reverse transcriptase were successfully purified to 40-80% homogeneity according to SDS-PAGE. Total protein concentration in purified RT samples was in range of 0.6-5.5 mg/ml. Mutant RT variants were-tested for reverse transcriptase activity at 37° C., 50° C. and residual activity at 37° C. after 5 min incubation at 50° C. (FIG. 8). Reverse transcriptase activity at 37° C. is normalized to be 100% and is omitted in FIG. 8. Thus only two types of columns (percents of RT activity at 50° C. and residual RT activity at 37° C. after 5 min incubation at 50° C.) are shown. As a control wt M-MuLV reverse transcriptase used for mutants library construction is presented. This primary enzyme was expressed in the same vector and purified in the same way as mutant variants of RT. An average value of wt enzyme RT activity at 50° C. is about 45% comparing to activity at 37° C. Almost all tested proteins, with few exceptions, have higher than 45% activity at 50° C. An average value of RT activity at 50° C. for all tested mutants is about ~92% and is more than 2 times higher comparing to wt enzyme (45%). Some mutants are 100% or even more active at 50° C. as they are at 37° C.: 20, 23, L5_16, L5_24, L5_30, L5_35, L5_37, L5_43, L5_46, L5_47, L5_49, L5_52, L5_55, L5_64, L5_65, L5_68, L5_72. The best mutants found have RT activity at 50° C. about 140% and more (3 times higher than 45% of wt): 20 (165%), L5_37 (162%), L5_43 (156%), L5_46 (135%), L5_47 (179%), L5_52 (137%), L5_64 (142%) and L5_68 (153%).

Even though majority of mutants have very high RT activities at 50° C., they are not as thermostable. Residual RT activity at 37° C. after 5 min incubation at 50° C. of wt control is ~11%. The same average residual activity of selected enzymes is also similar ~12%. Although some tested RT variants are substantially more thermostable and have residual activity 2-3 times higher than wt enzyme (11%): L5_8 (25%), L5_43 (32%), L5_46 (27%), L5_64 (28%), L5_65 (25%), L5_68 (31%).

Specific activity (u/mg of protein) for partially purified wt enzyme is ~200,000 u/mg (FIG. 9). Selected RT variants were expressed and purified in very diverse manner and an average specific activity (~155,000 u/mg) is slightly lower as for wt control (FIG. 9). In some cases specific activity is decreased, in some—increased (20—~274,000 u/mg; L5_11—~273, 000 u/mg; L5_28—~230,000 u/mg; L5_30—~224,000 u/mg; L5_35—~316,000 u/mg; L5_43—~328,000 u/mg; L5_46—~304,000 u/mg; L5_52—~310,000 u/mg; L5_64—~256,000 u/mg; L5_65—~247,000 u/mg).

It is obvious that our selection system works well. Using increased temperature of RT reaction as a selection pressure factor, we have managed to evolve faster (specific RT activity at 50° C. is higher) and more thermostable (residual RT activity at 37° C. after 5 min preincubation at 50° C.) reverse transcriptases.

The source of valuable information is an alignment of selected protein sequences (Appendix 2). Sequences of analyzed proteins, whose activity at 50° C. was substantially better as compared to primary wt M-MuLV (70% and more comparing to 45% of wt activity) are highlighted in grey (Appendix 2). Number of mutagenized amino acids varied in range of 0 (wt or L5_87) to 12 (L5_9). List of mutations found in all selected RT variants is given in Appendix 3. Proteins are sorted by decreasing number of mutations. Most mutants (53 out of 104) had 4-6 mutations per sequence. It is obvious that reverse transcriptase sequence has some hot spots, which are very important and beneficial for the RT reaction in general and for the thermostability of enzyme. Those hot spots can be easily identified in multiple sequence alignment (Appendix 2) as conglomeration of mutations at particular position. Especially important are mutations found in better performing variants of M-MuLV reverse transcriptase (sequences are highlighted in grey—Appendix 2). Summarized information about the most frequent mutations (in decreasing order) is given in Appendix 4. As in previous appendix mutant proteins with substantially higher activity at 50° C. are highlighted in grey. If same mutation repeats for many times and tested reverse transcriptases with this mutation are better performing at 50° C., that means this mutation is somehow beneficial for reverse transcription reaction.

According to the frequency with which mutations are found they can be divided into five classes: 21-31 repeats; 14-18 repeats; 4-7 repeats; 2-3 repeats and 1 repeat. The first group of the most frequent mutations comprises four amino acids D524 (31 repeats); D200 (30 repeats); D653 (23 repeats) and D583 (21 repeats). Two amino acids (D524 and D583) are known to complex magnesium ions in active centre of ribonuclease H domain. Mutants D524G, D583N and E562Q are used to turn off RNase H activity of M-MuLV reverse transcriptase (Gerard et al., 2002), what improves synthesis of cDNA. Results of our selection are strikingly similar. Mutation of aspartate 524 is found in 31 sequences out of 98. Moreover, D524N substitution is found once, D524A—10 times and finally D524G—20 times. Thus our selection not only precisely targeted important amino acids, but also the same amino acid substitutions, which are known to be the best. Exactly the same situation is with mutation of aspartate 583, which is repeated in 21 selected proteins out of 104. Substitution D583E is found once, D583A—3 times, D583G—7 times and finally D583N—10 times. Again, same amino acid and same substitution (D583N), which is known to be the best is selected most frequently. Commercial enzyme SUPERSCRIPT II from Invitrogen has three mutations: D524G, D583N and E562Q (WO2004024749). An interesting thing is that mutation of the third amino acid substitution E562 in our selection is found only once (E562K in L5_71). This result suggests that most likely glutamate 562 is not as important as aspartates 524 and 583, or for some reasons exchange of this amino acid can cause some side effects and is not beneficial for RT reactions performed at increased temperatures (>50° C.).

Further analysis of selected proteins sequences allowed to identify many more hot amino acids positions, mutations of which are described in other patent applications for improved M-MuLV reverse transcriptase: H204R—7 repeats (U.S. Pat. No. 7,078,208); H638R—4 repeats (US20050232934A1); T197A—2 repeats (U.S. Pat. No. 7,056,716); M289V(L), T306A(M)—2 repeats (U.S. Pat. No. 7,078,208); E302K, N454K—2 repeats (WO07022045A2); E69G, L435P—1 sequence (WO07022045A2); Y64C, Q190R, V223M, F309S—1 sequence (U.S. Pat. No. 7,056,716); E562K—1 sequence (U.S. Pat. No. 7,078,208). There are also two selected sequences of reverse transcriptases which have combination of three amino acids substitutions described in literature (30—D200N, T306M, 0524N, D583G; L5_28—T306k F309S, D524A, H594R, F625S).

In addition to known mutations we have identified many more amino acids positions which are mutated quite often: D200N(A, G)—30 repeats; D653N(G, A, H, V)—23 repeats; L603W(M)—18 repeats; T330P—15 repeats; L139P—14 repeats; Q221R—6 repeats; T287A—6 repeats; 149V(T)—5 repeats; N479D—5 repeats; H594R(Q)—5 repeats; F625S (L)—5 repeats; P65S—4 repeats; H126S(R)—4 repeats; L333Q(P)—4 repeats; A502V—4 repeats; E607K(G, A)—4 repeats; K658R(Q)—4 repeats; H8P(R)-3 repeats; P130S—3 repeats; E233K—3 repeats; Q237R—3 repeats; N249D—3 repeats; A283D(T)—3 repeats; A307V—3 repeats; Y344H—3 repeats; P407S(L)—3 repeats; M428L—3 repeats; Q430R—3 repeats; D449G(A)—3 repeats; A644V (T)—3 repeats; N649S—3 repeats; L671P—3 repeats; E673G(K)—3 repeats; N678I—3 repeats (Appendix 4).

Best performing variants of RT usually have mutations of amino acids, which are modified most frequently:
20 (50° C.-123%)—D200N (30 repeats), L603W (18 repeats) and slightly modified C terminus—N678I, S679P, R680A;

L5_35 (50° C.-125%)—D200N (30 repeats), T330P (15 repeats), N479D (5 repeats);
L5_37 (50° C.-162%)—H123S (4 repeats), L149F (1 sequence), D200N (30 repeats), N454K (2 repeats), D583N (21 repeats);
L5_43 (50° C.-160%)—D200N (30 repeats), Q237R (3 repeats), T330P (15 repeats), D524G (31 repeats), F625S (5 repeats), D653N (23 repeats);
L5_46 (50° C.-135%)—D200N (30 repeats), T330P (15 repeats), D583N (21 repeats), T644T (3 repeats);
L5_47 (50° C.-179%)—N107S (1 repeat), H126R (4 repeats), T128A (1 repeat), I179V (2 repeats), D200N (30 repeats), H642Y (2 repeats), D653N (23 repeats);
L5_52 (50° C.-137%)—D200N (30 repeats), T330P (15 repeats), Q374R (2 repeats), (D583N (21 repeats);
L5_64 (50° C.-142%)—D200N (30 repeats), D216G (2 repeats), D524G (31 repeats), E545G (2 repeats);
L5_65 (50° C.-127%)—D200N (30 repeats), Q238H (1 repeat), L570I (1 repeat), L603W (18 repeats);
L5_68 (50° C.-153%)—M39V (2 repeats), I49V (2 repeats), Q91R (2 repeats), H204R (7 repeats), T287A (6 repeats), N454K (2 repeats), F625L (5 repeats), D653H (23 repeats).

The combined data set of measured RT activities and sequence alignment analysis of mutant proteins allowed us to determine many beneficial mutations (and combinations thereof) in the sequence of M-MuLV reverse transcriptase sequence.

Example 3

Analysis of Moloney Murine Leukemia Virus Reverse Transcriptase Mutants

In vitro evolution experiment described in $2^{nd}$ example was very efficient. Gradually increased temperature of reverse transcription reaction was used as a selection pressure and generated a lot of different mutant variants of M-MuLV RT. Most of them were able to perform better at elevated temperatures comparing to primary enzyme. Sequence analysis of evolved reverse transcriptases indicates hot spots and most important amino acids positions (replacements), responsible for complex improvement of enzyme properties. In order to elucidate individual impact of different mutations single and multiple mutants of M-MuLV RT were constructed, partially purified and analyzed. Starting point for mutants construction was 7474 bp plasmid pET_his_MLV (SEQ ID No: 19) encoding M-MuLV RT with N-terminal. his-tag for fast protein purification using affinity chromatography. M-MuLV reverse transcriptase specific activity at 37° C., relative activity at 50° C. and relative residual activity at 37° C. after 5 min enzyme incubation at 50° C. were determined. In some cases RNase H activity was checked and cDNA synthesis reaction at different temperatures on 1 kb or 4.5 kb RNA was performed.

Methods and Materials

Initial plasmid pET_his_MLV (SEQ ID No: 19) was used as a starting material for mutagenic PCR. Mutations were introduced using mutagenic primers. Individual clones were sequenced and analyzed. M-MuLV RT mutants were expressed in T7 expression strain ER2566. Individual proteins and primary wt M-MuLV reverse transcriptase in the same construction were grown in 200 ml of LB to A590 ~0.7 and purified via his-tag by affinity chromatography using 2 ml of Qiagen-Ni-NTA Superflow resin (all purification was performed under native conditions according to suppliers recommendations). Elution was performed in 1 ml of EB (50 mM—NaH$_2$PO$_4$, 300 mM—NaCl, 250 mM—imidazol, pH 8.0, 10 mM—β-mercaptoethanol and 0.1% of triton X-100).

All proteins were dialyzed against 50 times excess of storage buffer (50 mM Tris-HCl (pH 8.3 at 25° C.), 0.1 M NaCl, 1 mM EDTA, 5 mM DTT, 0.1% (v/v) Triton X-100 and 50% (v/v) glycerol). Protein purity was checked on SDS-PAGE (usually ~40-80% of target protein). Protein concentration was determined using Bradford reagent (Fermentas #R1271).

MLV reverse transcriptase activities were measured at 37° C., 50° C. (enzyme diluted in special dilution buffer: 30 mM Tris-HCl pH 8.3 at 25° C., 10 mM DTT, 0.5 mg/ml BSA) and rest of activity at 37° C. after 5 min enzyme incubation at 50° C. (enzyme diluted and its stability measured in 1×RT reaction buffer: 50 mM Tris-HCl pH 8.3 at 25° C., 4 mM MgCl$_2$, 10 mM DTT, 50 mM KCl). Enzyme activity in all cases was assayed in the following final mixture: 50 mM Tris-HCl (pH 8.3 at 25° C.), 6 mM MgCl$_2$, 10 mM DTT, 40 mM KCl, 0.5 mM dTTP, 0.4 MBq/ml [31-1]-dTTP, 0.4 mM polyA.oligo(dT)$_{12-18}$. Activity units were determined measuring incorporation of dTMP into a polynucleotide fraction (adsorbed on DE-81) in 10 min at particular reaction temperature and comparing to known amounts of commercial enzyme. RNase H activity of M-MuLV reverse transcriptase variants was measured according to U.S. Pat. No. 5,405,776. RNase H activity of purified enzymes was assayed in reaction mixtures (50 µl) containing 50 mM Tris-HCl pH 8.3, 2 mM MnCl$_2$, 1 mM DTT and [3H](A)n*(dT)n (5 µM [3H](A)n, 35 cpm/µmol; 20 µM (dT)n). Reactions were incubated at 37° C. for 10 min and were stopped by adding 10 µl of tRNA (1 mg/ml) and 20 µl of cold 50% TCA. After 10 minutes on ice, the mixture was centrifuged for 10 minutes in an Eppendorf centrifuge (at 25000 g). Forty µl of the supernatant was counted in a LSC-universal cocktail (Roth—Rotiszint eco plus). One unit of RNase H activity is the amount of enzyme required to solubilize one mole of [3H](A)$_n$ in [3H](A)$_n$*(dT)$_n$ in 10 min at 37° C.

"RevertAid™ First Strand cDNA Synthesis Kit" (#K1622-Fermentas) and its control 1.1 kb RNA with a 3'-poly(A) tail in combination with oligo(dT)$_{18}$ primer was used to check purified reverse transcriptases for their ability to synthesize cDNA at different temperatures. Alternatively 4.5 kb RNA (synthesized from Eco31I linearized pTZ19R plasmid, which additionally contains piece of phage lambda DNA 5505-8469 bp) was used to test reverse transcription reaction. cDNA was synthesized 1 hr in 20 µl reaction volume using kit's components 1 µg of synthetic RNA, following provided protocol with only some minor modifications (without 5 min preincubation at 37° C.). Reverse transcription reactions were performed in 96 well PCR plate in Eppendorf Mastercycler gradient PCR machine applying corresponding temperature gradient. Synthesized cDNA was analyzed by alkaline agarose gel electrophoresis (staining with ethidium bromide). Samples of cDNA synthesis analysis on alkaline agarose gels are given in FIG. 16.

Results

According to the frequency, with which mutations are found during the evolution of M-MuLV reverse transcriptase, they can be divided into five classes: 21-31 repeats; 14-18 repeats; 4-7 repeats; 2-3 repeats and 1 repeat. Construction of individual reverse transcriptase mutants in general was performed according to this information. Most frequently found mutations were tested first. Reverse transcriptase specific activity at 37° C., relative activity at 50° C. and relative residual activity at 37° C. after 5 min enzyme incubation at 50° C. were determined. In some cases RNase H activity was checked and cDNA synthesis reaction at different temperatures on 1 kb or 4.5 kb RNA was performed. All experimental data on individual mutants are presented in Appendix 5. Second column ("Selection frequency") indicates the number of sequenced mutants, which had exact mutation and the number in the parentheses indicates total number of particular amino acid mutations found in selection. For example D200N—25 (30) means, that aspartate 200 replacement to asparagine was found 25 times out of 30 total D200 mutations. Reverse transcriptase specific activity measured at 37° C. is given in units per mg of protein. Relative enzyme activity at 50° C. and relative residual RT activity at 37° C. after 5 min incubation at 50° C. are given in percents normalized to specific activity (100%) of the same enzyme measured at 37° C. As a control (first line) is given wt M-MuLV reverse transcriptase used for mutants library construction. This primary enzyme is expressed in the same vector and purified in the same way as mutant variants of RT. Specific activity of wt enzyme is about 200,000 u/mg at 37° C., relative activity at 50° C. (comparing to activity at 37° C.)—45-50% (90,000-100,000 u/mg) and relative residual RT activity at 37° C. after 5 min incubation at 50° C. (comparing to activity at 37° C.) is about 11% (~22,000 u/mg). Wild type enzyme has about 160-200 u/mol of RNase H activity and can synthesize full length 1 kb cDNA at 48° C. It is known, that M-MuLV reverse transcriptase is protected from thermal inactivation by the binding to template-primer substrate and contrary, enzyme is less thermostable in solution alone (Gerard et al., 2002). Relative residual RT activity at 37° C. after 5 min incubation at 50° C. directly indicates enzyme thermostability in solution without substrate. Meanwhile relative activity at 50° C. represents enzyme thermostability in complex with RNA/DNA substrate and speed of cDNA synthesis. Fast mutant variant of reverse transcriptase will give increased numbers of polymerase units at 50° C., even if it's thermostability will be the same as wild type enzyme. Highest temperature of cDNA synthesis (in our case 1 kb or 4.5 kb) is the most comprehensive parameter, which represents general ability of enzyme to synthesize cDNA at increased temperatures. Reverse transcriptase mutants, which have at least 10% increased: specific activity at 37° (220,000 u/mg, 200,000 u/mg-wt), relative activity at 50° C. comparing to mutant activity at 37° C. (≥54%, 45-50%-wt) or relative residual activity at 37° C. after 5 min incubation at 50° C. comparing to mutant activity at 37° C. (≥13%, 11%-wt), are shadowed in gray and considered as significantly improved enzymes. Mutants able to synthesize full length 1 kb cDNA at temperatures higher than 48° C. are also shadowed in gray.

Reverse transcriptase mutants with increased specific activity (≥220,000 u/mg) at 37° C. are (Appendix 5):
D200 (D200N—254,000 u/mg; D200G—276,000 u/mg; D200H—234,000 u/mg),
(T330N—223,000 u/mg; T330D—240,000 u/mg),
Q221 (Q221R—268,000 u/mg),
H594 (H594K—270,000 u/mg; H594Q—231,000 u/mg),
D449 (D449E—224,000 u/mg; D449N—221,000 u/mg),
M39 (M39N—349,000 u/mg),
M66 (M66L—237,000 u/mg; M66V—227,000 u/mg; M66I—240,000 u/mg),
H126 (H126R—227,000 u/mg),
W388 (W388R—266,000 u/mg),
I179 (I179V—251,000 u/mg).

Reverse transcriptase mutants with increased relative activity (54%) at 50° C. (comparing to activity at 37° C.) are (Appendix 5):
D200 (D200N—84%; D200A—87%; D200Q—103%; D200E—79%; D200V—131%; D200W—103%; D200G—88%; D200K—102%; D200R—68%; D200H—54%),
L603 (L603W—105%; L603F—104%; L603Y—95%; L603M—77%),
D653 (D653N—93%; D653K—106%; D653A—99%; D653V—98%; D653Q—93%; D653L—83%; D653H—116%; D653G—90%; D653W—93%; D653E—80%),
T330 (T330P—80%; T330N—69%; T330D—55%; T330V—65%; T330S—67%),
Q221 (Q221R—94%; Q221K—77%; Q221E—64%; Q221M—58%; Q221Y—77%),
E607 (E607K—84%; E607A—98%; E607G—72%; E607D—69%),
L139 (L139P—59%),
T287 (T287S—68%),
N479 (N479D—81%),
H594 (H594R—69%; H594K—80%; H594Q—75%; H594N—61%),
D449 (D449G—79%; D449E—77%; D449N—75%; D449A—99%; 0449V—83%),
M39 (M39V—54%; M39N—71%),
M66 (M66L—79%; M66V—73%; M66I—80%),
L333 (L333Q—54%),
H126 (H126R—58%),
P130 (P130S—70%),
Q91 (Q91R—56%),
W388 (W388R—72%),
R390 (R390 W—64%),
Q374 (Q374R—56%),
E5 (E5K—67%).

Reverse transcriptase mutants with increased relative residual activity (≥13%) at 37° C. after 5 min incubation at 50° C. (comparing to activity at 37° C.) are (Appendix 5):
D200 (D200N—15%; D200A—18%; D200Q—23%; D200R—27%; D200H—27%),
L603 (L603W—23%; L603Y—13%; L603P—15%),
D653 (D653N—21%; D653K—15%; D653A—18%; D653V—16%; D653Q—18%; D653H—13%; D653G—13%; D653W—13%; D653E—19%),
T330 (T330P—21%; T330N—13%; T330D—16%; T330S—15%),
T287 (T287A—13%; T287F—13%),
H594 (H594R—14%; H594Q—13%),
D449 (D449G—13%),
M39 (M39V—13%),
M66 (M66L—13%),
Y344 (Y344H—13%),
Q91 (Q91R—13%),
N649 (N649S—16%),
W388 (W388R—14%).

Mutants able to synthesize full length 1 kb cDNA at temperatures higher than 48° C. are (Appendix 5):
D200 (D200N—50.4° C.; D200H—50.4° C.),
L603 (L603W—53.1° C.; L603F—50.4° C.; L603Y—47.8-50.4° C.),
D653 (D653N—50.4-53.1° C.; D653K—50.4-53.1° C.; D653A—50.4° C.; D653V—50.4° C.; D653Q—50.4° C.; D653L—50.4° C.; D653H—50.4-53.1° C.; D653G—50.4° C.; D653W—50.4° C.),
Q221 (Q221R—50.4° C.),
E607 (E607K—47.8-50.4° C.),
H594 (H594K—47.8-50.4° C.; H594Q—47.8-50.4° C.).

Samples of 1 kb cDNA synthesis analysis on alkaline agarose gels are given in FIG. 16 A-D.

According to collected biochemical data most important positions in M-MuLV reverse transcriptase sequence, which can impact cDNA synthesis at increased temperatures, are: D200, L603, D653, T330, Q221, E607, L139, T287, N479, H594, D449, M39, M66, L333, H126, Y344, P130, Q91, N649, W388, R390, I179, Q374, E5.

In general mutations of interest can be combined in between and M-MuLV reverse transcriptase thermostability with and without substrate, velocity, processivity and overall ability to synthesize cDNA at increased temperatures can be further improved. Some data, which illustrates enzyme improvement by combinatorial approach are presented in Appendix 6. Single mutants D200N and L603W have relative activity at 50° C. 84% and 105%. Highest temperatures of 1 kb cDNA synthesis are 50.4° C. and 53.1° C. Double mutant D200N; L603W has relative activity 131% at 50° C. and can synthesize 1 kb cDNA at 56° C. Triple mutant D200N; L603W; T330P (80% at 50° C.; 1 kb cDNA at 47.8° C.) is improved further and has relative activity 175% at 50° C. and can synthesize 1 kb cDNA at 56-58° C. Quadruple mutant D200N; L603W; T330P; E607K (84% at 50° C.; 1 kb cDNA at 47.8-50.1° C.) has relative activity 174% at 50° C. and can synthesize 1 kb cDNA at 60-62° C. Quintuple mutant D200N; L603W; T330P; E607K; L139P (59% at 50° C.; 1 kb cDNA at 47.8° C.) has relative activity 176% at 50° C. and can synthesize 1 kb cDNA at 62° C. and that is about 14° C. higher temperature comparing to wild type M-MuLV reverse transcriptase (1 kb cDNA at 47.8° C.). Additive character of thermostability is also observed in case of:

N479D, H594R mutants (D200N; L603W—131% at 50° C., 1 kb cDNA at 56° C. versus D200N; L603W; N479D; H594R—182% at 50° C., 1 kb cDNA at 56-58° C., 4.5 kb cDNA at 56-58° C.), T330P mutant (D200N; L603W; D653N; D524G—155% at 50° C., 1 kb cDNA at 58-60° C. versus D200N; L603W; D653N; D524G; T330P—180% at 50° C., 1 kb cDNA at 60-62° C.).

Samples of 4.5 kb cDNA synthesis analysis on alkaline agarose gels are given in FIG. 16 E-G.

Example 4

Modification of CRD—Selection for DNA Dependent DNA Polymerase Activity Using Biotin-dUTP (Proof of Principle)

This example illustrates activity-based selection strategy of reverse transcriptase as DNA dependent DNA polymerase, which is able to incorporate modified nucleotides into DNA-DNA substrate. The principle scheme of selection is schematically illustrated in FIG. 12. Two plasmids pET_his_MLV_D583N_pD (encoding RNase H minus Moloney Murine Leukemia Virus (M-MLV) reverse transcriptase fused to protein D spacer) and its derivative pET_his_del_pD (encoding inactivated reverse transcriptase; 57 amino acids deletion in pol domain and mutation D583N in RNase H domain, Example 1, SEQ ID No: 2) were used as a starting material in this example. Initial DNA fragments encoding active and inactive reverse transcriptases were synthesized in two separate polymerase chain reactions using plasmids pET_his_MLV_D583N_pD and pET_his_del_pD as a target. Synthesized PCR fragments were used in transcription reaction for synthesis of mRNA, which lacks STOP codon at the 3' end. Purified mRNAs were mixed to a ratio of 1:20=MLV (active RT):del (inactive RT). Double stranded DNA adapter (required for selection of DNA dependent DNA polymerase activity) was ligated to 3' mRNA by T4 DNA ligase. This mRNA-dsDNA complex is used for in vitro translation reaction. The ribosome moving along the mRNA stops translation at the site of RNA-DNA hybridization (Tabuchi et al., 2001). Ribosome-mRNA/dsDNA-protein complexes were stabilized (as in conventional ribosome display) by dilution of translation mixture with ice-cold buffer containing 50 mM $Mg^{2+}$. Mixture of ternary complexes (TC) was purified by ultracentrifugation on sucrose cushions. Purified ternary complexes ($<3*10^9$ molecules taken) containing mRNA-dsDNA linked to in vitro translated M-MuLV (RNase H—) reverse transcriptases were used to prepare reaction mixture additionally supplemented with biotin-dUTP and reaction buffer. Ice-cold reaction mixture was emulsified yielding ~$1*10^{10}$ water in oil compartments ~2 μm in size. Emulsified reaction mixture (less than one TC, ribosome-mRNA/dsDNA-protein per compartment) was incubated for 30 min at 37° C. After the temperature of compartmentalized reaction mixture is raised most of TCs dissociate releasing mRNA/dsDNA and reverse transcriptase. Successful incorporation reaction can occur only in compartments containing active M-MuLV (RNase H—) reverse transcriptase resulting in biotinylation of mRNA/dsDNA complex. Biotinylated complex can be selectively immobilized on streptavidin coated magnetic beads and specifically amplified by RT-PCR. As a result of successful experiment genes encoding active enzyme (in our case RT-PCR fragment of MLV_D583N_pD reverse transcriptase) should be enriched over genes encoding inactive enzyme (del_pD).

Methods and Materials

Production of mRNA/dsDNA Complex.

(1) Determination of Ligation Efficiency.

Efficiency of ligation reaction was determined by ligation of MLV_pD mRNA (synthesized from pET_his_MLV_pD plasmid, Example 1) with primer Long+Tb (SEQ ID No: 23) using ddC-Long2 primer (SEQ ID No: 22) as a splint. The 5' end of Long+Tb was previously phosphorylated using T4 Polynucleotide Kinase (Fermentas).

Annealing mix of 36 μl was prepared by mixing of 8.5 μmol (~10 μg) of purified MLV_pD mRNA with 4 times of molar excess of Long+Tb (SEQ ID No: 23) and 4.2 times of molar excess of ddC-Long2 (SEQ ID No: 22) in nuclease free water. The mixture was incubated at 70° C. for 5 min and then cooled to room temperature for 20 min. Before adding ligation reaction components mixture was moved to cooling stand for 2 min.

4.5 μl of 10× ligation buffer and 4.5 μl of T4 DNA ligase (5v/μl) (Fermentas) were added to 36 μl of annealing mixture. Ligation reaction was performed for 30 min at 37° C. and followed extraction once with equal volume of Roti® Phenol/chloroform (ROTH) and twice with equal volume of chloroform. Assuming that mRNA amount was close to initial amount taken for ligation reaction ~5 μg of ligation products mix was diluted to 43 μl by nuclease free water. Aliquot of 2 μl of resultant mixture was left for analysis on agarose gel before immobilization on Dynabeads M-280 Streptavidin beads (Dynabeads® kilobase BINDER™ Kit (DYNAL Biotech)).

10 μl of resuspended Dynabeads was transferred to a 1.5 ml microcentrifuge tube, washed with 50 μl of Binding Solution provided in the kit. The tube was placed on the magnet for 1-2 min until beads settled at the tube and solution was removed. Dynabeads were gently resuspended by pipetting in 38 μl of Binding Solution supplemented with 2 μl of aqueous tRNA (tRNA from yeast (Roche)) solution (1 μg/μl) to minimize non-specific mRNA binding. 40 μl of Dynabeads in Binding solution was added to solution (~40 μl) containing ligation products mix. The tube was incubated shaking at the +22° C. in termomixer (Eppendorf) for 60 min. After the binding of ligated mRNA/dsDNA, supernatant was removed and the beads were washed three times with 50 μl of Washing Solution (supplied in the kit). Collected Dynabeads with immobilizes ligated mRNA/dsDNA complex was resuspended in 26 μl of nuclease free water and followed extraction once with 40 µl of Roti® Phenol/chloroform (ROTH) and twice with 40 µl volume of chloroform to release mRNA/dsDNA complex from magnetic beads. 1; 2 and 5 µl of final mix were analysed on agarose gel along with sample (2 µl) left before immobilization and Mass Ruler™High Range DNA ladder. Amount of mRNA in mRNA/DNA complex purified on streptavidin beads was determined comparing mRNA amounts before and after the immobilization. The yield of recovered mRNA was ~60%, what means that at least 60% of mRNA was successfully ligated with DNA duplex, resulting in mRNA/dsDNA complex.

(2) Determination of Biotin-dUTP Incorporation Efficiencies into mRNA/dsDNA Complex and into Self Primed mRNA.

As it was shown in first mRNA to dsDNA ligation experiment ligation reaction efficiency is ~60% and more. Free mRNA left in ligation mixture can self prime and participate in extension reaction using M-MuLV reverse transcriptase and biotin-dUTP. This experiment was performed in order to demonstrate that mRNA/dsDNA complex (ligation product) is better substrate than free self primed mRNA.

MLV_D583N_pD mRNA was ligated with long+ oligonucleotide (SEQ ID No: 21) according procedure described above (construction of initial plasmids pET_his_MLV_D583N_pD and pET_his_delpD in details is described in Example 1). ~12.5 ng of prepared (MLV_D583N_pD mRNA/long+) substrate was combined with ~12.5 ng of del_pD mRNA previously incubated at 70° C. for 5 min, then cooled to room temperature for 20 min in nuclease free water, in total volume of 12.5 µl. The second mix for dTTP or biotin-dUTP incorporation by reverse transcriptase was prepared: 8 µl of 5× Reaction buffer for reverse transcriptase; 1 µl-40 u/µl RiboLock™ RNase inhibitor (Fermentas); 18.6 µl nuclease-free water; 0.4 µl-200 u/µl RevertAid™ Minus M-MuLV Reverse transcriptase (Fermentas). Prepared mix was divided to two tubes 2×15 µl and 1 µl of 1 mM dTTP (Femientas) or 1 µl of 1 mM biotin-dUTP (Fermentas) was added. Subsequentially 5 µl of substrate (from the first mix) was added to dTTP and biotin-dUTP containing mixtures. Reactions were carried out at 37° C. for 60 min. After that 1 µl of 0.5M EDTA (pH 8.0) was added to both samples and reaction mixtures were extracted once with equal volume of Roti® Phenol/chloroform (ROTH) and once with equal volume of chloroform followed by purification on G-50 MicroColumns (GE Healthcare). 2 µl of resultant reaction products were left for direct RT reaction (without streptavidin beads purification) and the remaining part of solutions were used for biotinylated mRNA-dsDNA complex immobilization on Dynabeads M-280 Streptavidin beads (Dynabeads® kilobase BINDER™ Kit (DYNAL Biotech)). 10 µl of resuspended Dynabeads was transferred to a 1.5 ml microcentrifuge tube, washed with 25 µl of provided Binding Solution. The tube was placed on the magnet for 1-2 min until beads settled at the bottom of the tube and solution was removed. Dynabeads were gently resuspended by pipetting in 90 µl of Binding Solution and 2 µl of aqueous tRNA (tRNA from yeast (Roche)) solution (1 µg/µl) was added to minimize non-specific mRNA binding. 40 µl of Dynabeads in Binding solution was added to solution (~40 µl) containing the elongated by dTTP and biotin-dUTP RNA-DNA fragments. The tubes were incubated at the +22° C. in termomixer (Eppendorf) for 40 min by shaking (1400 rpm). After the binding step, supernatant was removed and the beads were washed three times with 50 µl of Washing Solution (provided in the kit) shaking (1400 rpm) for 5 min at +22° C. Collected Dynabeads with immobilizes elongated mRNA-dsDNA complex was resuspended in reverse transcription reaction mixture. Reverse transcription reaction mixture was prepared on ice: 20 µl-5× reaction buffer for Reverse Transcriptase (Fermentas); 10 µl-10 mM dNTP (Fermentas); 2.5 µl-40 u/µl RiboLock RNase inhibitor (Fermentas); 5 µl-20 µM pD_42 oligonucleotide (SEQ ID No: 8); 2.5 µl RevertAid™ Minus M-MuLV Reverse transcriptase (200 u/µl) (Fermentas); 55 µl nuclease-free water. Prepared mix was divided to five 19 µl (5×19 µl) aliquots: two were used to resuspend Dynabeads with immobilized elongated mRNA/dsDNA complex or mRNA, the other two were transferred to the tubes with samples left without streptavidin beads purification and to the rest of 19 µl aliquot was added 1 µl of nuclease free water-egative reaction control to prove, that reaction mixture is not contaminated by DNA. All reaction mixtures were incubated by shaking (1000 rpm) at the +42° C. in termomixer (Eppendorf) for 1 hour until cDNA synthesis reaction was finished.

Amplification of cDNA was performed by nested PCR. Initial PCR mixture was prepared on ice: 14 µl-10× Taq buffer with KCl (Fermentas); 14 µl-2 mM of each dNTP (Fermentas); 8.4 µl-25 mM MgCl$_2$ (Fermentas); 2.8 µl-1 u/µl LC (recombinant) Taq DNA Polymerase (Fermentas); 0.7 µl-100 µM M_F primer (SEQ ID No: 11); 0.7 µl-100 µM M_2R primer (SEQ ID No: 12); 92.4 µl water-mixture was divided into 7 samples for 19 µl (7×19 µl). To 5×19 µl of PCR master mix were added 1 µl of cDNA (1-5 RT samples); to the 6$^{th}$ tube of PCR master mix 1 µl of water was added—negative PCR control; to the 7$^{th}$ tube (positive PCR control)—1 µl of pET_his_MLV_D583N_pD plasmid (~1 ng) was added. The cycling protocol was: initial denaturation step 3 min at 94° C., 25 cycles (45-sec at 94° C., 45 sec at 57° C., and 1 min at 72° C.) and final elongation 3 min at 72° C.

Predicted amplicons size 907 bp for MLV_D583N_pD and 736 bp for del_pD cDNA. PCR products were analyzed on 1% agarose gel loading 10 µl of PCR mix per well (FIG. 13).

As it was expected efficient cDNA amplification is observed only in elongation reaction with biotin-dUTP. Very faint bands of amplified cDNA can be detected in elongation reaction with dTTP and can be explained by weak nonspecific binding of mRNA to streptavidin beads. After purification on streptavidin beads DNA encoding MLV_D583N_pD gene (907 bp) is enriched over DNA of del_pD (736 bp). That means mRNA/dsDNA complex is elongated by biotin-dUTP much more efficiently than self primed del_pD mRNA.

(3) Preparation of mRNA Mixture (MLV_D583N_pD:del_pD=1:20) and RNA/dsDNA Complex.

Preparation of PCR fragments for in vitro transcription. PCR mixture was prepared on ice: 20 µl-10× Taq buffer with KCl (Fermentas); 20 µl-2 mM of each dNTP (Fermentas); 12 µl-25 mM MgCl$_2$ (Fermentas); 16 µl—DMSO (D8418—Sigma); 4 µl-1 u/µl LC (recombinant) Taq DNA Polymerase (Fermentas); 1 µl-100 µM pro-pIVEX primer (SEQ ID No: 3); 1 µl-100 µM pD-ter—primer (SEQ ID No: 20); 122 µl water-mixture divided into two tubes 2×98 µl. To 2×98 µl of PCR master mix were added either 2 µl of pET_his_MLV_D583N_pD (diluted to ~1 ng/µl) or 2 µl of pET_his_del_pD (diluted to ~1 ng/µl) (construction of initial plasmids pET_his_MLV_D583N_pD and pET_his_del_pD in details is described in Example 1). The cycling protocol was: initial denaturation step 3 min at 94° C., 30 cycles (45 sec at 94° C., 45 sec at 53° C., and 2 min at 72° C.) and final elongation 5 min at 72° C. Amplification efficiency was ~7000 fold from 2 ng of plasmid (7873 bp) target to ~5 µg (50 ng/µl) of amplified product (2702 bp PCR fragment MLV_D583N_pD from pET_his_MLV_D583N_pD; 2531 bp PCR fragment del_pD from pET_his_del_pD).

Transcription mixture was prepared: 80 µl-5×T7 transcription buffer (1 M HEPES-KOH pH 7.6; 150 mM Mg acetate; 10 mM spermidin; 0.2 M DTT); 56 µl-112 mM of each NTP (Fermentas); 16 μl-20 u/μl T7 RNA polymerase (Fermentas); 8 μl-40 u/μl RiboLock RNase inhibitor (Fermentas); 114 μl nuclease-free water-mixture divided into two tubes 2×165 μl and add 35 μl-20 ng/μl of PCR fragment MLV_D583N_pD (unpurified PCR mixture) or 35 μl-20 ng/μl of PCR fragment del_pD PCR (unpurified PCR mixture). Transcription was performed 2 hr at 37° C.

Both transcription mixtures were diluted to 200 μl with ice-cold nuclease-free water and 200 μl of 6 M LiCl solution were added. Mixtures incubated 25 min at +4° C. and centrifuged for 25 min at +4° C. in cooling centrifuge at max speed (25,000 g). Supernatant was discarded and RNA pellet washed with 500 μl of ice-cold 75% ethanol. Tubes were centrifuged again for 5 min at +4° C. at max speed and supernatant was discarded. RNA pellet was dried for 5 min at room temperature and subsequently resuspended in 400 μl of nuclease-free ice-cold water by shaking for 15 min at +4° C. and 1400 rpm. Tubes were centrifuged again for 5 min at +4° C. at max speed to separate not dissolved RNA. About 380 μl of supernatant were transferred to new tube with 42 μl of 10× DNase I buffer ($Mg^{2+}$) (Fermentas); 3 μl-1 u/μl DNaseI (RNase-free) (Fermentas) and incubated for 20 min at +37° C. to degrade DNA. Reaction mixtures were extracted once with equal volume of Roti® Phenol/chloroform (ROTH) and twice with equal volume of chloroform to remove DNaseI. 43 μl of 3 M Sodium acetate pH 5.0 solution and 1075 μl of ice-cold 96% ethanol were added to each tube. Finally RNA was precipitated by incubation for 30 min at −20° C. and centrifugation for 25 min at +4° C. at max speed (25,000 g). Supernatant was discarded and RNA pellet washed with 500 μl of ice-cold 75% ethanol. Tubes were centrifuged again for 4 min at +4° C. at max speed and supernatant was discarded. RNA pellet was dried for 5 min at room temperature and subsequently resuspended in 150 μl of nuclease-free ice-cold water by shaking (1400 rpm) for 15 min at +4° C. RNA solution was aliquot for 10 μl and liquid nitrogen frozen. Concentration of mRNA was measured spectrophotometrically and double-checked on agarose gel along with RiboRuler™ RNA Ladder, High Range (Fermentas).

mRNA/dsDNA complex was produced by ligation of long+ oligodeoxynucleotide to mRNA using ddC-Long2 oligodeoxynucleotide as a splint. The 5' end of long+ was previously phosphorylated using T4 Polynucleotide Kinase (Fermentas). Oligodeoxynucleotide ddC-Long2 has 3' end modification (ddC) in order to prevent possibility of 3' end extension by reverse transcriptase on its natural RNA-DNA substrate. Annealing mix of 50 μl was prepared by mixing of 17 μmol of purified mRNA mixture at ratio of 1:20=MLV_D583N_pD (active RT): del_pD (inactive RT) with 4.3 time of molar excess of long+ and 4.1 time of molar excess of ddC-Long2 in nuclease free water. The mixture was incubated at 70° C. for 5 min and then cooled to room temperature for 20 min. Before adding ligation reaction components mixture was moved to cooling stand for 2 min.

5 μl of 10× ligation buffer and 5 μl of T4 DNA ligase (5 v/μl) (Fermentas) were added to 40 μl of annealing mixture. Negative ligation reaction was carried out using the same annealing mixture in 1× ligation buffer without T4 DNA ligase. Prepared ligation reaction mixtures were incubated at 37° C. for 30 min. To stop ligation 1 μl of 0.5M EDTA (pH 8.0) was added to both tubes and reaction mixtures were extracted once with equal volume of Roti® Phenol/chloroform (ROTH) and twice with equal volume of chloroform followed by concentration of reaction products at 30° C. for 10 min in vacuum Concentrator 5301 (Eppendorf). Desalting was performed using illiustra ProbeQuant G-50 MicroColumns (GE Healthcare). Concentrations of ligation products were determined on agarose gel along with RiboRuler™ RNA Ladder, High Range (Fermentas)—mRNA mixture (MLV_D583N_pD:del_pD=1:20) ligated to long+/ddC-Long2 oligodeoxynucleotides ~0.24 μg/μl (sample with T4 DNA ligase) and simple mRNA mixture with long+/ddC-Long2 oligodeoxynucleotides ~0.06 μg/μ1 (sample without T4 DNA ligase).

(4) General Control of mRNA/dsDNA Complex by Incorporation of [α-$P^{33}$]dATP.

Prepared mRNA/dsDNA complex (substrate) was tested for dTTP (or biotin-dUTP) and subsequent [α-$P^{33}$]dATP incorporation by reverse transcriptase. Reaction mixture: 16 μl of 5× Reaction buffer for reverse transcriptase; 4 μl-40 u/μl RiboLock™ RNase inhibitor (Fermentas); 2 μl [α-$P^{33}$]dATP (10 mCi)/ml, SRF-203 (Hartmann Analytic)); 35 μl nuclease free water; 1 μl-200 u/μl RevertAid™ Minus M-MuLV Reverse transcriptase (Fermentas). Prepared mix was divided to two tubes 2×28 μl and 2 μl of 1 mM dTTP (Fermentas) or 2 μl of 1 mM biotin-dUTP (Fermentas) was added. Resultant mixtures were divided to two tubes 2×15 μl. To first tube 1.25 μl (~0.3 μg) of ligation products plus 3.75 μl of nuclease free water were added. To second tube 5 (~0.3 μg) of negative ligation reaction products were added. Reaction mixtures were incubated at 37° C. for 30 min. After that, 1 μl of 0.5M EDTA (pH 8.0) was added to all tubes and reaction mixtures were extracted once with equal volume of Roti® Phenol/chloroform (ROTH) and twice with equal volume of chloroform followed by purification on illiustra ProbeQuant G-50 MicroColumns (GE Healthcare). Reactions products were analyzed on agarose gel along with RiboRuler™. RNA Ladder, High Range (Fermentas) FIG. 14A. In all samples (with and without ligase) we can see discreet band (~2500b) of del_pD mRNA (20 times smaller amount of MLV_D583N_pD mRNA ~2700b, which was present in mRNA mixture can not be distinguished). Subsequently agarose gel was dried on filter paper and radiolabeled mRNA/dsDNA complex (at the same position as mRNA) was detected only in case of positive ligation samples (with ligase) and not in case of negative ligation samples (without ligase) FIG. 14B.

(5) Selection for DNA Dependent DNA Polymerase Activity Using Biotin-dUTP.

Previously prepared mRNA/dsDNA complex (mRNA mix MLV_D583N_pD (active RT):del_pD (inactive RT)=1:20) was used for in vitro translation employing synthetic Wako-PURE system (295-59503—Wako). Translation mixture for WakoPURE system (25 μA: 12.5 μl—A solution (Wako); 5 μl—B solution (Wako); 0.5 μl-40 u/μl RiboLock RNase inhibitor (Fermentas); 0.25 μl-1 M DTT; 1.75 μl nuclease-free water and 5 μl-0.24 μg/μl mRNA/dsDNA substrate (~1200 ng). In vitro translation was performed for 120 min at 37° C.

Translations (~25 μl) was stopped by adding 155 μl of ice-cold stop buffer $WBK_{500}$+DTT+triton (50 mM Tris-acetate pH 7.5 at 25° C.; 50 mM NaCl; 50 mM Mg-acetate; 500 mM KCl; 10 mM DTT; 0.1% (v/v)-Triton X-100 (T8787—Sigma)) and centrifuged for 5 min at +4° C. and 25,000 g. Very carefully 160 µl of centrifuged translation mixture was transferred on the top of 840 µl 35% (w/v) sucrose solution in WBK$_{500}$+DTT+Triton X-100 (50 mM Tris-acetate pH 7.5 at 25° C.; 50 mM NaCl; 50 mM Mg-acetate; 500 mM KCl; 10 mM DTT; 0.1% (v/v)—Triton X-100 (T8787—Sigma); 35% (w/v)—sucrose (84097—Fluka)) to transparent 1 ml ultra-centrifugation tubes (343778—Beckman). Ternary complexes (TC) consisted of mRNA/dsDNA-ribosome-protein (tRNA) were purified by ultracentrifugation at TL-100 Beckman ultracentrifuge in TLA100.2 fixed angle rotor (Beckman) at 100,000 rpm for 9 min at +4° C. Initially 750 µl of solution was removed from the very top of the centrifugation tube. Then (very carefully to keep small transparent pellet of TC at the bottom of ultracentrifugation tube intact) tube walls were washed with 750 µl of WBK$_{500}$ (50 mM tris-acetate pH 7.5 at 25° C.; 50 mM NaCl; 50 mM Mg-acetate; 500 mM KCl). Finally all solution was removed starting from the very top of the centrifugation tube and pellet was dissolved in 30 µl of ice-cold stop buffer WBK$_{500}$+DTT+triton (50 mM Tris-acetate pH 7.5 at 25° C.; 50 mM NaCl; 50 mM Mg-acetate; 500 mM KCl; 10 mM DTT; 0.1% (v/v)—Triton X-100 (T8787—Sigma)).

As it was determined using radioactively labeled mRNA after ultracentrifugation 5%-30% of input mRNA is located in ternary complex pellet. Therefore it was predicted to have less than 360 ng (30% from 1200 ng mRNA used in translation reaction) of mRNA in 30 µl of buffer (~12 ng/µl or 9*10$^9$ molecules/µl of ternary complex).

Modified nucleotide incorporation reaction mix was prepared on ice by mixing: 5 µl-5× reaction buffer for Reverse Transcriptase (Fermentas); 1.25 µl-40 u/☐l RiboLock RNase inhibitor (Fermentas); 2.5 µl-1 mM biotin-dUTP (Fermentas); 40.95 µl nuclease-free water and 0.3 µl of purified (<2.7*10$^9$ molecules) TC. According to the protocol 50 µl of nucleotide incorporation reaction mix contains <2.7*10$^9$ molecules of ternary complex.

Oil-surfactant mixture was prepared by mixing ABIL EM 90 (Goldschmidt) into mineral oil (M5904—Sigma) to final concentration of 4% (v/v) (Ghadessy and Holliger, 2004; US2005064460). Emulsions were prepared at +4° C. in 5 ml cryogenic vials (430492—Corning) by mixing 950 µl of oil-surfactant mixture with 50 µl of RT mixture. Mixing was performed using MS-3000 magnetic stirrer with speed control (Biosan) at ~2100 rpm; Rotilabo®—(3×8 mm) magnetic bar with centre ring (1489.2—Roth); water phase was added in 10 µl aliquots every 30 sec, continuing mixing for 2 more minutes (total mixing time—4 min). According to optical microscopy data compartments in prepared emulsions vary from 0.5 µm to 10 µm in size with average diameter of ~2 µm. Therefore it was expected to have ~1*10$^{10}$ water in oil compartments after the emulsification of 50 µl reverse transcription reaction mixture, which contains less than 2.7*10$^9$ molecules of ternary complex (about one mRNA-dsDNA complex and reverse transcriptase molecules per 3-4 compartments).

Prepared emulsion was incubated 30 min at +37° C.

To recover the reaction mixture from emulsion 20 µl of 0.1M EDTA was added to emulsion, stirred for 10 sec, then 50 µl phenol/chloroform mix was added and stirred for additional 10 sec. After that, emulsion was transferred to 1.5 ml microcentrifuge tube, 0.5 ml of water-saturated ether was added mixed by vortexing and centrifuged for 10 min at room temperature for 16,000 g. Oil-ether phase was removed leaving concentrated (but still intact) emulsion at the bottom of the tube. Finally emulsions were broken by extraction with 0.9 ml water-saturated ether; 0.9 ml water-saturated ethylacetate (in order to remove ABIL EM 90 detergent) and twice 0.9 ml water-saturated ether. Water phase was dried for 12 min under vacuum at room temperature followed removal of incorporated nucleotides on illiustra ProbeQuant G-50 MicroColumns (GE Healthcare). 2 µl aliquot of resultant mixture was left for direct RT reaction (without streptavidin beads purification) and the remaining part of solution was used for biotinylated mRNA/dsDNA complex immobilization on Dynabeads M-280 Streptavidin beads (DYNAL Biotech).

Dynabeads® kilobase BINDER™ Kit (DYNAL Biotech) was used for isolation of biotinylated mRNA-dsDNA complex according provided product description. 5 µl of resuspended Dynabeads was transferred to a 1.5 ml microcentrifuge tube, washed with 20 µl of provided Binding Solution. The tube was placed on the magnet for 1-2 min until beads settled at the tube and solution was removed. Dynabeads were gently resuspended by pipetting in 50 µl of Binding Solution and 1 µl of aqueous tRNA (tRNA from yeast (Roche)) solution (1 µg/µl) was added to minimize non-specific mRNA binding. 50 µl of Dynabeads in Binding solution were added to solution (~50 µl) containing the biotinylated RNA-DNA fragments. The tube was incubated shaking at the +22° C. in termomixer (Eppendorf) for 1 hour. After the binding of mRNA/dsDNA, supernatant was removed from the beads, and the beads were washed two times with 50 µl of Washing Solution (provided in the kit) shaking (1400 rpm) for 5 min at +22° C. and once with 50 µl of Washing Solution shaking (1400 rpm) for 12 min at +22° C. Collected Dynabeads with immobilized biotinylated mRNA/dsDNA complex were resuspended in reverse transcription reaction mixture.

Reverse transcription reaction mixture for selected mRNA/dsDNA complex was prepared on ice: 12 µl-5× reaction buffer for Reverse Transcriptase (Fermentas); 6 µl-10 mM dNTP (Fermentas); 1.5 µl-40 u/☐l RiboLock RNase inhibitor (Fermentas); 0.3 µl-20 µM pD_42 oligonucleotide (SEQ ID No: 8); 1.5 µl RevertAid™ Minus M-MuLV Reverse transcriptase (200 u/µl) (Fermentas); 35.7 µl nuclease-free water. Prepared mix was divided to three 19 ☐l aliquots: one was used to resuspend Dynabeads with immobilized biotinylated mRNA/dsDNA complex, the other aliquot of 19 µl was transferred to the tube with sample of elongated mRNA/dsDNA complex left without streptavidin beads purification and to the rest of 19 ☐l aliquot was added 1 ☐l of nuclease free water (negative reaction control—to prove that reaction mixture is not contaminated). All reaction mixtures were incubated by shaking (1000 rpm) at the +42° C. in termomixer (Eppendorf) for 1 hour.

Amplification of cDNA was performed by nested PCR. Initial PCR mixture was prepared on ice: 10 µl-10× Taq buffer with KCl (Fermentas); 10 µl-2 mM of each dNTP (Fermentas); 6 µl-25 mM MgCl$_2$ (Fermentas); 2 µl-1 u/µl LC (recombinant) Taq DNA Polymerase (Fermentas); 1-2.5 u/µl Pfu DNA Polymerase (Fermentas); 0.5 µl-100 µM RD_Nde primer (SEQ ID No: 9); 0.5 µl-100 µM pD__55 primer (SEQ ID No: 10); 65 µl water-mixture was divided into 5 samples for 19 µl (5×19 µl). To 3×19 µl of PCR master mix were added 1 µl of cDNA (1-3 RT samples); to one tube with 19 µl of PCR master mix 1 µl water was added—negative PCR control. For positive PCR control 1 µl of pET_his_MLV_pD plasmid (~1 ng) was added. The cycling protocol was: initial denaturation step 3 min at 94° C., 30 cycles (45 sec at 94° C., 45 sec at 58° C., and 3 min at 72° C.) and final elongation 5 min at 72° C.

Nested PCR mixture for partial gene amplification (for better resolution of MLV_D583N_pD:del_pD cDNA ratio in RT samples) was prepared on ice: 20 µl-10× Taq buffer with KCl (Fermentas); 20 µl-2 mM of each dNTP (Fermentas); 12 µl-25 mM MgCl$_2$ (Fermentas); 0.9 µl-5 u/µl Taq DNA Polymerase (Fermentas); 1.0 µl-100 µM M_F primer (SEQ ID No: 11); 1.0 µl-100 µM M__2R primer (SEQ ID No: 12); 135.1 µA water-mixture was divided 5×38 µl. 2 µl of first PCR (primers set RD_Nde//pD__55) product were added to prepared nested PCR mixture. Master mix was mixed again and divided into two tubes (2×20 µl) for 30 or 35 PCR cycles amplification. The cycling protocol was: initial denaturation step 3 min at 94° C., 30 or 35 cycles (45 sec at 94° C., 45 sec at 57° C., and 1 min at 72° C.) and final elongation 3 min at 72° C. Expected length of PCR fragments was 907 bp for MLV_D583N_pD and 736 bp for del_pD. Amplification was analyzed on 1% agarose gel loading 10 µl of PCR mix per well (FIG. 15).

Results

1. Double stranded (dsDNA) adaptor was successfully ligated to mRNA using T4 DNA ligase. Ligation efficiency is about 60% as it was determined by ligation of dsDNA-biotin adapter. mRNA/dsDNA complex can be specifically purified on streptavidin beads, providing an opportunity to discriminate between biotin labelled and unlabelled substrates. Free mRNA is much worse substrate for DNA dependent DNA polymerase comparing to mRNA/dsDNA. As a consequence 60% ligation efficiency of dsDNA to mRNA is good enough and such a substrate can be successfully used in evolution scheme.

2. General selection experiment using mRNA/dsDNA complex (mRNA mixture MLV_D583N_pD:del_pD=1:20) was performed. In vitro translation was performed using WakoPURE protein translation system and compartmentalized biotin-dUTP incorporation reaction in to dsDNA was carried out to demonstrate the enrichment of genes encoding active (MLV_D583N_pD) reverse transcriptase over genes encoding inactivated enzyme (del_pD). According to selection scheme (FIG. 12) incorporation reaction of biotin-dUTP should occur only in aqueous compartments containing active (MLV_D583N_pD) reverse transcriptase resulting in biotinylation of mRNA/dsDNA complex. DNA dependent DNA polymerase is selected by binding of the biotinylated complex to streptavidin immobilized on magnetic beads, and then the selected gene-is amplified by RT-PCR. Genes encoding active enzyme (in our case RT-PCR fragment for MLV_D583N_pD reverse transcriptase) were enriched over genes encoding inactive enzyme (FIG. 15). Initial ratio of genes MLV_D583N_pD:del_pD was 1:20 and final ratio (after enrichment) was ~1:1. Respectively an enrichment factor in this particular experiment was ~20 folds. Enrichment factors calculated from different experiments varied in range from 5 to 200. And it was confirmed that DNA dependent DNA polymerase could be selected for modified nucleotide incorporation applying Compartmentalized Ribosome Display (CRD) method. Selection of conventional DNA dependent DNA polymerases can be performed straight away. Biotin-dUTP can be exchanged to different nucleotide analogues of interest including nucleotide analogues having 3' modifications. After the incorporation of such nucleotide analogues into DNA strand 3' end is blocked, can't be extended and elongation reaction will be terminated. This approach is used in sequencing by synthesis (SBS) scheme and DNA polymerase suitable for SBS can be easily evolved using compartmentalized ribosome display (CRD) technique.

REFERENCES

Mattheakis L C, Bhatt R R, Dower W J. An in vitro polysome display system for identifying ligands from very large peptide libraries. Proc Natl Acad Sci USA. 1994 Sep. 13; 91(19):9022-6.

Matsuura T, Pluckthun A. Selection based on the folding properties of proteins with ribosome display. FEBS Lett. 2003 Mar. 27; 539(1-3):24-8.

Hanes J, Pluckthun A. In vitro selection and evolution of functional proteins by using ribosome display. Proc Natl Acad Sci USA. 1997 May 13; 94(10):4937-42.

He M, Taussig M J. Antibody-ribosome-mRNA (ARM) complexes as efficient selection particles for in vitro display and evolution of antibody combining sites. Nucleic Acids Res. 1997 Dec. 15; 25(24):5132-4.

Irving R A, Coia G, Roberts A, Nuttall S D, Hudson P J. Ribosome display and affinity maturation: from antibodies to single V-domains and steps towards cancer therapeutics. J Immunol Methods. 2001 Feb. 1; 248(1-2):31-45. Review.

Amstutz P, Pelletier J N, Guggisberg A, Jermutus L, Cesaro-Tadic S, Zahnd C, Pluckthun A. In vitro selection for catalytic activity with ribosome display: J Am Chem Soc. 2002 Aug. 14; 124(32):9396-403.

Takahashi F, Ebihara T, Mie M, Yanagida Y, Endo Y, Kobatake E, Aizawa M. Ribosome display for selection of active dihydrofolate reductase mutants using immobilized methotrexate on agarose beads. FEBS Lett. 2002 Mar. 6; 514(1):106-10.

Tawfik D S, Griffiths A D. Man-made cell-like compartments for molecular evolution. Nat Biotechnol. 1998 July; 16(7): 652-6.

Lee Y F, Tawfik D S, Griffiths A D. Investigating the target recognition of DNA cytosine-5 methyltransferase HhaI by library selection using in vitro compartmentalisation. Nucleic Acids Res. 2002 Nov. 15; 30(22):4937-44.

Cohen H M, Tawfik D S, Griffiths A D. Altering the sequence specificity of HaeIII methyltransferase by directed evolution using in vitro compartmentalization. Protein Eng Des Sel. 2004 January; 17(1):3-11.

Ghadessy F J, Ong J L, Holliger P. Directed evolution of polymerase function by compartmentalized self-replication. Proc Natl Acad Sci USA. 2001 Apr. 10; 98(8):4552-7. Epub 2001 Mar. 27.

Ghadessy F J, Ramsay N, Boudsocq F, Loakes D, Brown A, Iwai S, Vaisman A, Woodgate R, Holliger P. Generic expansion of the substrate spectrum of a DNA polymerase by directed evolution. Nat Biotechnol. 2004 June; 22(6): 755-9. Epub 2004 May 23.

Ong J L, Loakes D, Jaroslawski S, Too K, Holliger P. Directed evolution of DNA polymerase, RNA polymerase and reverse transcriptase activity in a single polypeptide. J Mol Biol. 2006 Aug. 18; 361(3):537-50. Epub 2006 Jul. 5.

Bernath K, Hai M, Mastrobattista E, Griffiths A D, Magdassi S, Tawfik D S. In vitro compartmentalization by double emulsions: sorting and gene enrichment by fluorescence activated cell sorting. Anal Biochem. 2004 Feb. 1; 325(1): 151-7.

Mastrobattista E, Taly V, Chanudet E, Treacy P, Kelly B T, Griffiths A D. High-throughput screening of enzyme libraries: in vitro evolution of a beta-galactosidase by fluorescence-activated sorting of double emulsions. Chem Biol. 2005 December; 12(12):1291-300.

Bertschinger J, Neri D. Covalent DNA display as a novel tool for directed evolution of proteins in vitro. Protein Eng Des Sel. 2004 September; 17(9):699-707. Epub 2004 Nov. 2.

Doi N, Yanagawa H. STABLE: protein-DNA fusion system for screening of combinatorial protein libraries in vitro. FEBS Lett. 1999 Aug. 27; 457(2):227-30.

Yonezawa M, Doi N, Kawahashi Y, Higashinakagawa T, Yanagawa H. DNA display for in vitro selection of diverse peptide libraries. Nucleic Acids Res. 2003 Oct. 1; 31(19): e118.

Sepp A, Choo Y. Cell-free selection of zinc finger DNA-binding proteins using in vitro compartmentalization. J Mol Biol. 2005 Nov. 25; 354(2):212-9. Epub 2005 Oct. 3.

Sepp A, Tawfik D S, Griffiths A D. Microbead display by in vitro compartmentalisation: selection for binding using flow cytometry. FEBS Lett. 2002 Dec. 18; 532(3):455-8.

Griffiths A D, Tawfik D S. Directed evolution of an extremely fast phosphotriesterase by in vitro compartmentalization. EMBO J. 2003 Jan. 2; 22(1):24-35.

Bernath K, Magdassi S, Tawfik D S. Directed evolution of protein inhibitors of DNA-nucleases by in vitro compartmentalization (IVC) and nano-droplet delivery. J Mol Biol. 2005 Feb. 4; 345(5):1015-26. Epub 2004 Dec. 7.

Thorsen T, Roberts R W, Arnold F H, Quake S R. Dynamic pattern formation in a vesicle-generating microfluidic device. Phys Rev Lett. 2001 Apr. 30; 86(18):4163-6.

Okushima S, Nisisako T, Torii T, Higuchi T. Controlled production of monodisperse double emulsions by two-step droplet breakup in microfluidic devices. Langmuir. 2004 Nov. 9; 20(23):9905-8.

Song H, Tice J D, Ismagilov R F. A microfluidic system for controlling reaction networks in time. Angew Chem Int Ed Engl. 2003 Feb. 17; 42(7):768-72.

Link D R, Grasland-Mongrain E, Dud A, Sarrazin F, Cheng Z, Cristobal G, Marquez M, Weitz D A. Electric control of droplets in microfluidic devices. Angew Chem Int Ed Engl. 2006 Apr. 10; 45(16):2556-60.

Matsuura T, Yanagida H, Ushioda J, Urabe I, Yomo T. Nascent chain, mRNA, and ribosome complexes generated by a pure translation system. Biochem Biophys Res Commun. 2007 Jan. 12; 352(2):372-7. Epub 2006 Nov. 17.

Gerard G F, D'Alessio J M, Kotewicz M L, Noon M C. Influence on stability in *Escherichia coli* of the carboxyterminal structure of cloned Moloney murine leukemia virus reverse transcriptase. DNA. 1986 August; 5(4):271-9.

Forrer P, Jaussi R. High-level expression of soluble heterologous proteins in the cytoplasm of *Escherichia coli* by fusion to the bacteriophage lambda head protein D. Gene. 1998 Dec. 11; 224(1-2):45-52.

Gerard G F, Potter R J, Smith M D, Rosenthal K, Dhariwal G, Lee J, Chatterjee D K. The role of template-primer in protection of reverse transcriptase from thermal inactivation. Nucleic Acids Res. 2002 Jul. 15; 30(14):3118-29.

Vichier-Guerre S, Ferris S, Auberger N, Mahiddine K, Jestin J L. A population of thermostable reverse transcriptases evolved from *Thermus aquaticus* DNA polymerase I by phage display. Angew Chem Int Ed Engl. 2006 Sep. 18; 45(37):6133-7.

Ghadessy F J, Holliger P. A novel emulsion mixture for in vitro compartmentalization of transcription and translation in the rabbit reticulocyte system. Protein Eng Des Sel. 2004 March; 17(3):201-4. Epub 2004 Feb. 27.

Roberts R W, Szostak J W. RNA-peptide fusions for the in vitro selection of peptides and proteins. Proc Natl Acad Sci USA. 1997 Nov. 11; 94(23):12297-302.

Odegrip R, Coomber D, Eldridge B, Hederer R, Kuhlman P A, Ullman C, FitzGerald K, McGregor D. CIS display: In vitro selection of peptides from libraries of protein-DNA complexes. Proc Natl Acad Sci USA. 2004 Mar. 2; 101(9): 2806-10. Epub 2004 Feb. 23.

Reiersen H, Løbersli I, Løset G A, Hvattum E, Simonsen B, Stacy J E, McGregor D, Fitzgerald K, Welschof M, Brekke O H, Marvik O J. Covalent antibody display—an in vitro antibody-DNA library selection system. Nucleic Acids Res. 2005 Jan. 14; 33(1):e10.

Bertschinger J, Neri D. Covalent DNA display as a novel tool for directed evolution of proteins in vitro. Protein Eng Des Sel. 2004 September; 17(9):699-707. Epub 2004 Nov. 2.

Stein V, Sielaff I, Johnsson K, Hollfelder F. A covalent chemical genotype-phenotype linkage for in vitro protein evolution. Chembiochem. 2007 Dec. 17; 8(18):2191-4.

Tabuchi I, Soramoto S, Nemoto N, Husimi Y. An in vitro DNA virus for in vitro protein evolution. FEBS Lett. 2001 Nov. 23; 508(3):309-12.

Applicants incorporate by reference the material contained in the accompanying computer readable Sequence Listing identified as SEQ_TXT.txt, having a file creation date of Feb. 29, 2012 2:09 P.M. and file size of 651 kilobytes.

What is claimed is:

1. An isolated reverse transcriptase having an optimum activity at a temperature above 42° C., wherein the optimum activity at a temperature above 42° C. is an increased activity of the isolated reverse transcriptase compared to the activity of the isolated reverse transcriptase at 37° C., and wherein the reverse transcriptase comprises SEQ ID NO: 25 with at least one mutation selected from the group consisting of D200Q; D200V; D200 W; D200K; L603W; L603F; D653K; D653H; D200N, L603W; D200N, L603W, T330P; D200N, L603W, T330P, E607K; D200N, L603W, T330P, E607K, L139P; D200N, L603W, N479D, H594R; D200N, L603W, D653N, D524G; and D200N, L603W, D653N, D524G, T330P.

2. The reverse transcriptase according to claim 1, wherein the optimum activity is at a temperature in the range of from 50° C. to 60° C.

3. An isolated reverse transcriptase comprising SEQ ID NO: 25 with at least one mutation selected from the group consisting of L139P, D200A, G, Q, V, W or K, L603W or F, and D653K or H.

4. An isolated reverse transcriptase of claim 1, wherein the activity at 50° C. is at least 120% of the activity at 37° C.

5. The reverse transcriptase of claim 3 further comprising at least one mutation at an amino acid position selected from the group consisting of E5, M39, I49, M66, Q91, P130, I179, D200, Q221, Q237, T287, A307, T330, L333, Y344, Q374, W388, R390, Q430, D449, N479, A502, H594, L603, E607, A644, N649, D653, K658, L671, and E673.

6. The reverse transcriptase according to claim 5, having at least one mutation selected from the group consisting of E5K; M39V or L; I49V or T; M66L; Q91R or L; P130S; I179T or V; D200N; Q221R; Q237R; T287A; A307V; T330P; L333Q; Y344H; Q374R; W388R; R390 W; Q430R; D449G or A; N479D; A502V; H594R or Q; L603M E607K, G or A; A644V or T; N649S; D653G, A or V; K658R or Q; L671P; and E673G or K.

* * * * *

UNITED STATES PATENT AND TRADEMARK OFFICE
CERTIFICATE OF CORRECTION

PATENT NO. : 8,580,548 B2  
APPLICATION NO. : 13/408732  
DATED : November 12, 2013  
INVENTOR(S) : Janulaitis et al.

Page 1 of 1

It is certified that error appears in the above-identified patent and that said Letters Patent is hereby corrected as shown below:

In the Claims:

Column 52, claim 6, lines 14-15 reads
"Y344H; Q374R; W388R; R390 W; Q430R; D449G or A; N479D; A502V; H594R or Q; L603M E607K, G or A;"

Column 52, claim 6, lines 14-15 should read
--Y344H; Q374R; W388R; R390W; Q430R; D449G or A; N479D; A502V; H594R or Q; L603M; E607K, G or A;--

Signed and Sealed this  
Seventh Day of January, 2014

Margaret A. Focarino  
*Commissioner for Patents of the United States Patent and Trademark Office*

UNITED STATES PATENT AND TRADEMARK OFFICE
CERTIFICATE OF CORRECTION

| | | |
|---|---|---|
| PATENT NO. | : 8,580,548 B2 | Page 1 of 110 |
| APPLICATION NO. | : 13/408732 | |
| DATED | : November 12, 2013 | |
| INVENTOR(S) | : Janulaitis et al. | |

It is certified that error appears in the above-identified patent and that said Letters Patent is hereby corrected as shown below:

Please delete patent 8580548 in its entirety and insert patent 8580548 in its entirety shown on the attached pages.

Signed and Sealed this
Twenty-eighth Day of October, 2014

Michelle K. Lee
*Deputy Director of the United States Patent and Trademark Office*

(12) United States Patent
Janulaitis et al.

(10) Patent No.: US 8,580,548 B2
(45) Date of Patent: *Nov. 12, 2013

(54) PRODUCTION OF NUCLEIC ACID

(75) Inventors: Arvydas Janulaitis, Vilnius (LT);
Remigijus Skirgaila, Vilnius (LT);
Dangira Siksniene, Vilnius (LT)

(73) Assignee: Thermo Fisher Scientific Baltics, UAB, Vilnius (LT)

(*) Notice: Subject to any disclaimer, the term of this patent is extended or adjusted under 35 U.S.C. 154(b) by 0 days.

This patent is subject to a terminal disclaimer.

(21) Appl. No.: 13/408,732

(22) Filed: Feb. 29, 2012

(65) Prior Publication Data

US 2012/0156752 A1   Jun. 21, 2012

Related U.S. Application Data

(63) Continuation of application No. 12/899,641, filed on Oct. 7, 2010, and a continuation of application No. PCT/EP2009/054329, filed on Apr. 9, 2009.

(30) Foreign Application Priority Data

Apr. 10, 2008 (GB) .................................... 0806562

(51) Int. Cl.
*C12N 9/12* (2006.01)
(52) U.S. Cl.
USPC .................................................. 435/194
(58) Field of Classification Search
None
See application file for complete search history.

(56) References Cited

U.S. PATENT DOCUMENTS

| | | |
|---|---|---|
| 5,244,797 A | 9/1993 | Kotewicz et al. |
| 5,405,776 A | 4/1995 | Kotewicz et al. |
| 6,063,608 A | 5/2000 | Kotewicz et al. |
| 6,136,582 A | 10/2000 | Gao et al. |
| 7,056,716 B2 | 6/2006 | Potter et al. |
| 7,078,208 B2 * | 7/2006 | Smith et al. ............. 435/194 |
| 2004/0209276 A1 | 10/2004 | Smith et al. |
| 2005/0064460 A1 | 3/2005 | Holliger et al. |
| 2005/0232934 A1 | 10/2005 | Chen et al. |
| 2006/0094050 A1 | 5/2006 | Potter et al. |
| 2007/0141592 A1 | 6/2007 | Smith et al. |

FOREIGN PATENT DOCUMENTS

| | | |
|---|---|---|
| EP | 0494955 | 7/1998 |
| EP | 1019496 | 9/2004 |
| EP | 1268766 | 11/2005 |
| EP | 1712617 | 10/2006 |
| WO | WO 00/42199 * | 7/2000 |
| WO | 01/68895 | 9/2001 |
| WO | 01/75097 | 10/2001 |
| WO | 02/22869 | 3/2002 |
| WO | 03/044187 | 5/2003 |
| WO | 2004/024749 A2 | 3/2004 |
| WO | 2004/024917 | 3/2004 |
| WO | 2005/049787 | 6/2005 |
| WO | 2006/051552 | 5/2006 |
| WO | 2007/011045 A1 | 1/2007 |
| WO | 2007/022045 | 2/2007 |
| WO | 2007/022045 A2 | 2/2007 |
| WO | WO2007022045 A2 * | 2/2007 |
| WO | 2008/029085 | 3/2008 |

OTHER PUBLICATIONS

International Search Report, PCT/EP2009/054329 (mailed Jan. 22, 2010; published Mar. 11, 2010).
Griffiths, et al., "Man-made enzymes—from design to in vitro compartmentalisation", Current Opinion in Biotechnology, vol. 11, No. 4, pp. 338-353, (Aug. 2000).
Griffiths, et al., "Directed evolution of an extremely fast phosphotriesterase by in vitro compartmentalization" The EMBO Journal, vol. 22, No. 1 pp. 24-35 (Jan. 2003).
Cohen, et al., "Altering the sequence specificity of HaeIII methyltransferase by directed evolution using in vitro compartmentalization, Protein Engineering Design & Selection", vol. 17, No. 1, pp. 3-11 (Jan. 2004).
Kelly et al., "Miniaturizing chemistry and biology in microdroplets", Chem Commun., No. 18, pp. 1773-1788 (May 2007).
International Search Report, GB0806562.5, Aug. 13, 2008.
International Search Report, GB0806562.5, Nov. 13, 2008.
Aharoni A et al. High-throughput screens and selections of enzyme-encoding genes. Curr. Opin. Chem. Biol., vol. 9, 2005, pp. 210-216.
Amstutz P, Pelletier JN, Guggisberg A, Jermutus L, Cesaro-Tadic S, Zahnd C, Pluckthun A. In vitro selection for catalytic activity with ribosome display. J Am Chem Soc. Aug. 14, 2002;124(32):9396-403.
AMV Reverse Transcriptase Certificate of Analysis, Fermentas Life Sciences, revised Nov. 22, 2006.
Bernath K, Hai M, Mastrobattista E, Griffiths AD, Magdassi S, Tawfik DS. In vitro compartmentalization by double emulsions: sorting and gene enrichment by fluorescence activated cell sorting. Anal Biochem. Feb. 1, 2004;325(1):151-7.

(Continued)

*Primary Examiner* — Christina Bradley
*Assistant Examiner* — Lianko Garyu
(74) *Attorney, Agent, or Firm* — Thompson Hine LLP

(57) ABSTRACT

The present invention provides a process for the production of nucleic acid encoding a target protein, which comprises: (a) providing an array of RNA or DNA molecules including one or more encoding the target protein; (b) generating a target protein from the array to form RNA-protein or DNA-protein complexes in which the RNA or DNA molecule is non-covalently or covalently bound to the complex; (c) separating the complexes into compartments wherein most or all of the compartments contain no more than one complex; (d) subjecting the complexes to reaction conditions which allow target protein activity; and (e) selecting nucleic acid encoding the target protein on the basis of the activity associated therewith, wherein when the complex is a DNA-protein complex in which the DNA is non-covalently bound, step b) is performed in the absence of separate compartments for each complex.

6 Claims, 16 Drawing Sheets

(56) References Cited

OTHER PUBLICATIONS

Bernath K, Magdassi S, Tawfik DS. Directed evolution of protein inhibitors of DNA-nucleases by in vitro compartmentalization (IVC) and nano-droplet delivery. J Mol Biol. Feb. 4, 2005;345(5):1015-26. EPUB Dec. 7, 2004.

Bertschinger J, Neri D. Covalent DNA display as a novel tool for directed evolution of proteins in vitro. Protein Eng Des Sel. Sep. 2004;17(9):699-707. Epub Nov. 2, 2004.

Blain SW et al. Nuclease activities of Moloney murine leukemia virus reverse transcriptase. J.Biol. Chem. vol. 268, 1993, pp. 23585-23592.

Doi N, Yanagawa H. Stable: protein-DNA fusion system for screening of combinatorial protein libraries in vitro. FEBS Lett. Aug. 27, 1999;457(2):227-30.

Forrer P, Jaussi R. High-level expression of soluble heterologous proteins in the cytoplasm of *Escherichia coli* by fusion to the bacteriophage lambda head protein D. Gene. Dec. 11, 1998;224(1-2):45-52.

Gerard GF, D'Alessio JM, Kotewicz ML, Noon MC. Influence on stability in *Escherichia coli* of the carboxy-terminal structure of cloned Moloney murine leukemia virus reverse transcriptase. DNA. Aug. 1986;5(4):271-9.

Gerard GF, Potter RJ, Smith MD, Rosenthal K, Dhariwal G, Lee J, Chatterjee DK. The role of template-primer in protection of reverse transcriptase from thermal inactivation. Nucleic Acids Res. Jul. 15, 2002;30(14):3118-29.

Ghadessy FJ, Ong JL, Holliger P. Directed evolution of polymerase function by compartmentalized self-replication. Proc Natl Acad Sci U S A. Apr. 10, 2001;98(8):4552-7. Epub Mar. 27, 2001.

Ghadessy FJ, Ramsay N, Boudsocq F, Loakes D, Brown A, Iwai S, Vaisman A, Woodgate R, Holliger P. Generic expansion of the substrate spectrum of a DNA polymerase by directed evolution. Nat Biotechnol. Jun. 2004;22(6):755-9. Epub May 23, 2004.

Ghadessy FJ, Holliger P. A novel emulsion mixture for in vitro compartmentalization of transcription and translation in the rabbit reticulocyte system. Protein Eng Des Sel. Mar. 2004;17(3):201-4. Epub Feb. 27, 2004.

Goedken E R et al. Metal binding and activation of the ribonuclease H domain from Moloney murine leukemia virus. Protein Engineer., vol. 12, 1999, pp. 975-980.

Hanes J, Pluckthun A. In vitro selection and evolution of functional proteins by using ribosome display. Proc Natl Acad Sci U S A. May 13, 1997;94(10):4937-42.

He M, Taussig MJ. Antibody-ribosome-mRNA (ARM) complexes as efficient selection particles for in vitro display and evolution of antibody combining sites. Nucleic Acids Res. Dec. 15, 1997;25(24):5132-4.

Irving RA, Coia G, Roberts A, Nuttall SD, Hudson PJ. Ribosome display and affinity maturation: from antibodies to single V-domains and steps towards cancer therapeutics. J Immunol Methods. Feb. 1, 2001;248(1-2):31-45. Review.

Kelly B T et al. Selective gene amplification. Protein Engineer. Design Select., vol. 20, 2007, pp. 577-581.

Lee YF, Tawfik DS, Griffiths AD. Investigating the target recognition of DNA cytosine-5 methyltransferase HhaI by library selection using in vitro compartmentalisation. Nucleic Acids Res. Nov. 14, 2002;30(22):4937-44.

Lim D et al. Mutations of the RNase H C helix of the Moloney Murine Leukemia Virus Reverse Transcriptase Reveal Defects in Polypurine Tract Recognition, J.Virol., vol. 76, 2002, pp. 8360-8373.

Link DR, Grasland-Mongrain E, Duri A, Sarrazin F, Cheng Z, Cristobal G, Marquez M, Weitz DA. Electric control of droplets in microfluidic devices. Angew Chem Int Ed Engl. Apr. 10, 2006;45(16):2556-60.

Mastrobattista E, Taly V, Chanudet E, Treacy P, Kelly BT, Griffiths AD. High-throughput screening of enzyme libraries: in vitro evolution of a beta-galactosidase by fluorescence-activated sorting of double emulsions. Chem Biol. Dec. 2005;12(12):1291-300.

Mattheakis LC, Bhatt RR, Dower WJ. An in vitro polysome display system for identifying ligands from very large peptide libraries. Proc Natl Acad Sci U S A. Sep. 13, 1994;91(19):9022-6.

Matsuura T, Pluckthun A. Selection based on the folding properties of proteins with ribosome display. FEBS Lett. Mar. 27, 2003;539(1-3):24-8.

Matsuura T, Yanagida H, Ushioda J, Urabe I, Yomo T. Nascent chain, mRNA, and ribosome complexes generated by a pure translation system. Biochem Biophys Res Commun. Jan. 12, 2007;352(2):372-7. Epub Nov. 17, 2006.

Odegrip R, Coomber D, Eldridge B, Hederer R, Kuhlman PA, Ullman C, FitzGerald K, McGregor D. CIS display: In vitro selection of peptides from libraries of protein-DNA complexes. Proc Natl Acad Sci U S A. Mar. 2, 2004;101(9):2806-10. Epub Feb. 23, 2004.

Okushima S, Nisisako T, Torii T, Higuchi T. Controlled production of monodisperse double emulsions by two-step droplet breakup in microfluidic devices. Langmuir. Nov. 9, 2004;20(23):9905-8.

Ong JL, Loakes D, Jaroslawski S, Too K, Holliger P. Directed evolution of DNA polymerase, RNA polymerase and reverse transcriptase activity in a single polypeptide. J Mol Biol. Aug. 18, 2006;361(3):53750. Epub Jul. 5, 2006.

Reiersen H, Løbersli I, Løset GA, Hvattum E, Simonsen B, Stacy JE, McGregor D, Fitzgerald K, Welschof M, Brekke OH, Marvik OJ. Covalent antibody display—an in vitro antibody-DNA library selection system. Nucleic Acids Res. Jan. 14, 2005;33(1):e10.

Roberts RW, Szostak JW. RNA-peptide fusions for the in vitro selection of peptides and proteins. Proc Natl Acad Sci U S A. Nov. 11, 1997;94(23):12297-302.

Sepp A, Choo Y. Cell-free selection of zinc finger DNA-binding proteins using in vitro compartmentalization. J Mol Biol. Nov. 25, 2005;354(2):212-9. Epub Oct. 3, 2005.

Sepp A, Tawfik DS, Griffiths AD. Microbead display by in vitro compartmentalisation: selection for binding using flow cytometry. FEBS Lett. Dec. 18, 2002;532(3):455-8.

Song H, Tice JD, Ismagilov RF. A microfluidic system for controlling reaction networks in time. Angew Chem Int Ed Engl. Feb. 17, 2003;42(7):768-72.

Stein V, Sielaff I, Johnsson K, Hollfelder F. A covalent chemical genotype-phenotype linkage for in vitro protein evolution. Chembiochem. Dec. 17, 2007;8(18):2191-4.

Tabuchi I, Soramoto S, Nemoto N, Husimi Y. An in vitro DNA virus for in vitro protein evolution. FEBS Lett. Nov. 23, 2001;508(3):309-12.

Takahashi F, Ebihara T, Mie M, Yanagida Y, Endo Y, Kobatake E, Aizawa M. Ribosome display for selection of active dihydrofolate reductase mutants using immobilized methotrexate on agarose beads. FEBS Lett. Mar. 6, 2002;514(1):106-10.

Tawfik DS, Griffiths AD. Man-made cell-like compartments for molecular evolution. Nat Biotechnol. Jul. 1998;16(7):652-6.

Thorsen T, Roberts RW, Arnold FH, Quake SR. Dynamic pattern formation in a vesicle-generating microfluidic device. Phys Rev Lett. Apr. 30, 2001;86(18):4163-6.

Vichier-Guerre S, Ferris A, Auberger N, Mahiddine K, Jestin JL. A population of thermostable reverse transcriptases evolved from *Thermus aquaticus* DNA polymerase I by phage display. Angew Chem Int Ed Engl. Sep. 18, 2006;45(37):6133-7.

Yonezawa M, Doi N, Kawahashi Y, Higashinakagawa T, Yanagawa H. DNA display for in vitro selection of diverse peptide libraries. Nucleic Acids Res. Oct. 1, 2003;31(19):e118.

Partial European Search Report, European Application No. 13167553.0 (Aug. 2, 2013).

The State Intellectual Property Office of China, 3rd Notification of Office Action, Chinese Application No. 200980121472.X (Jul. 22, 2013), 12 pages.

The State Intellectual Property Office of China, Search Report, Chinese Application No. 200980121472.X (Jul. 1, 2013), 5 pages.

NCBI Reference Sequence NP_057933.2, Pr180 [Moloney murine leukemia virus], 2 pages (Sep. 28, 2010), pp. 1-2.

Skirgaila, R. et al., "Compartmentalization of destabilized enzyme-mRNA-ribosome complexes generated by ribosome display: a novel tool for the directed evolution of enzymes," Protein Engineering, Design & Selection, vol. 26, No. 7, pp. 453-461 (2013).

Baranauskas, A. et al., "Generation and characterization of new highly thermostable and processive M-MuLV reverse transcriptase variants," Protein Engineering, Design & Selection, vol. 25, No. 10, pp. 657-668 (2012).

\* cited by examiner

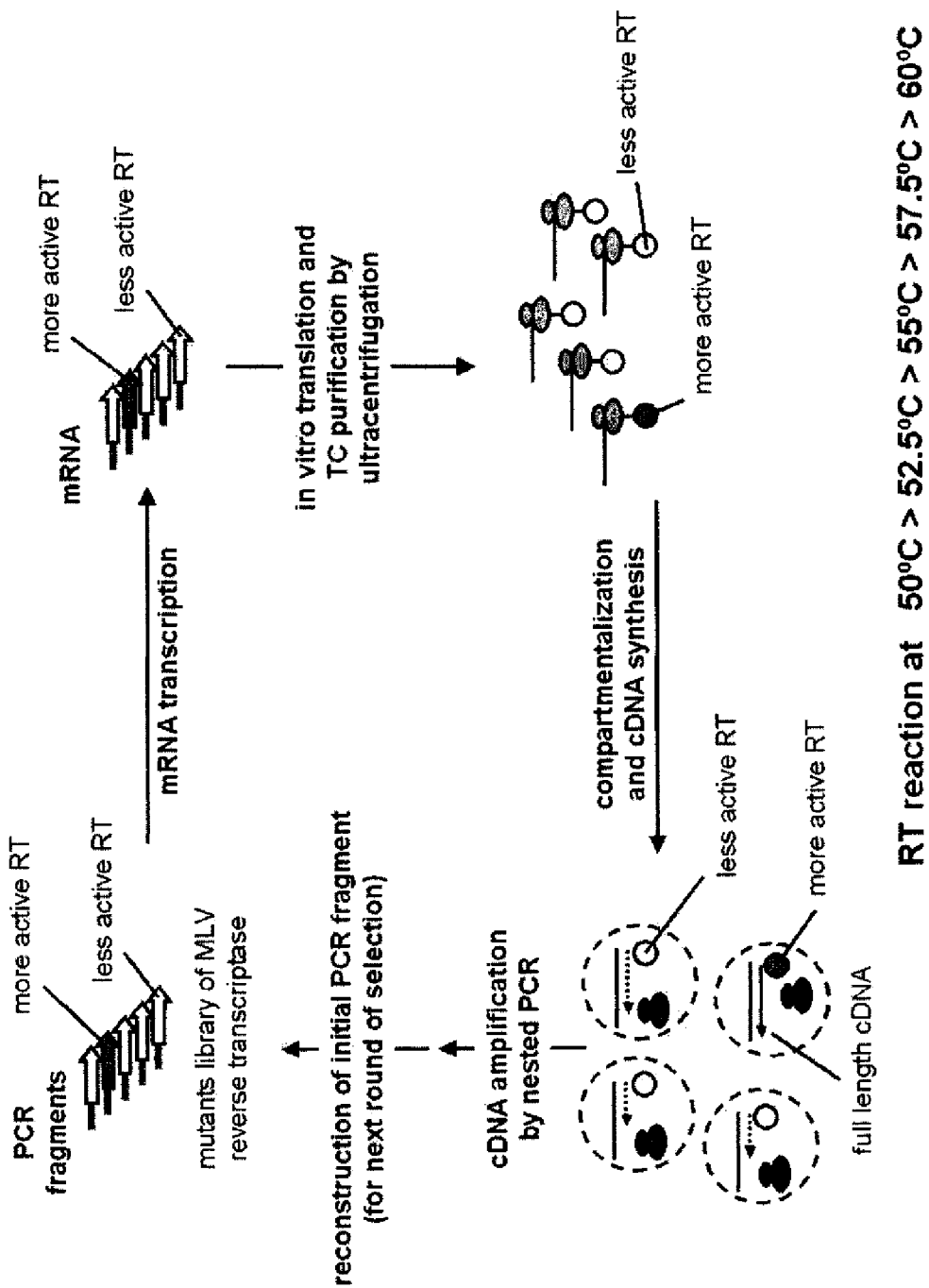

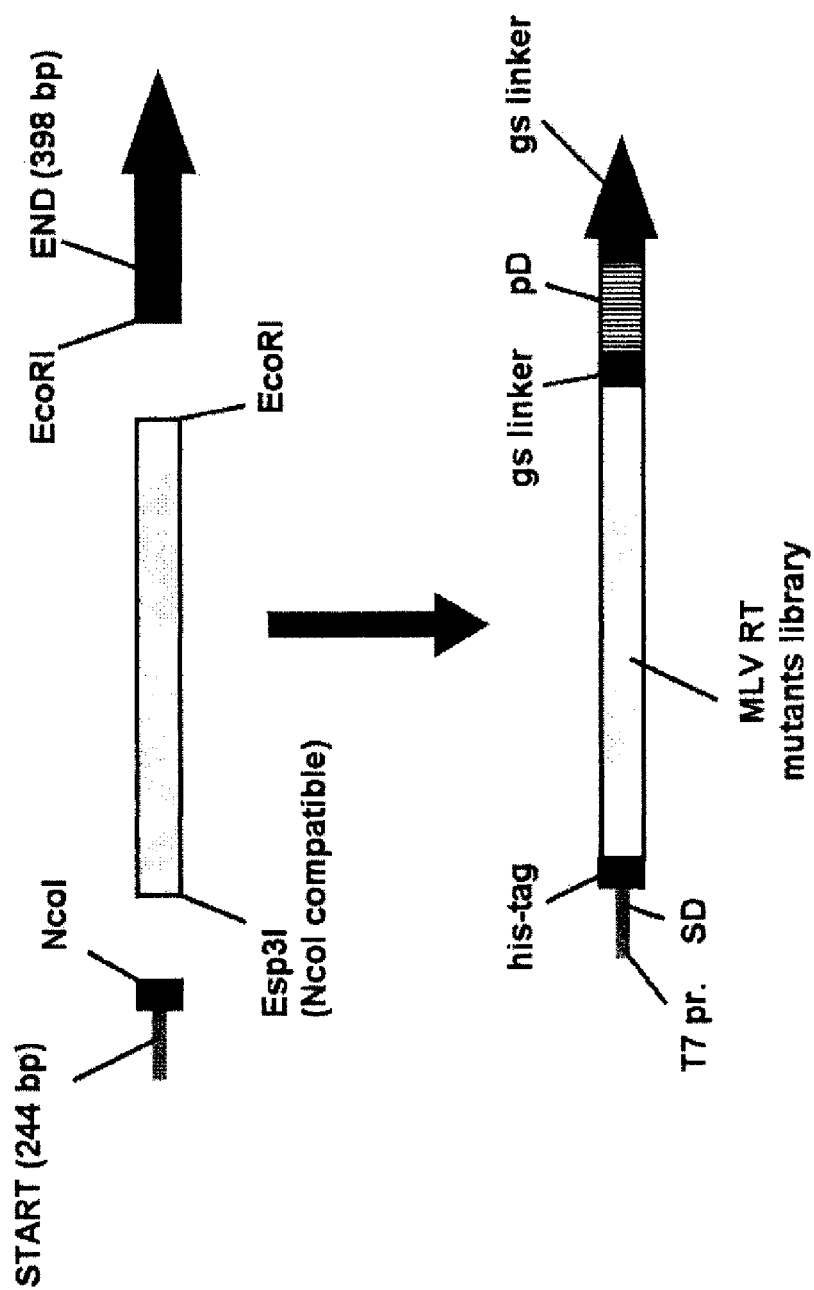

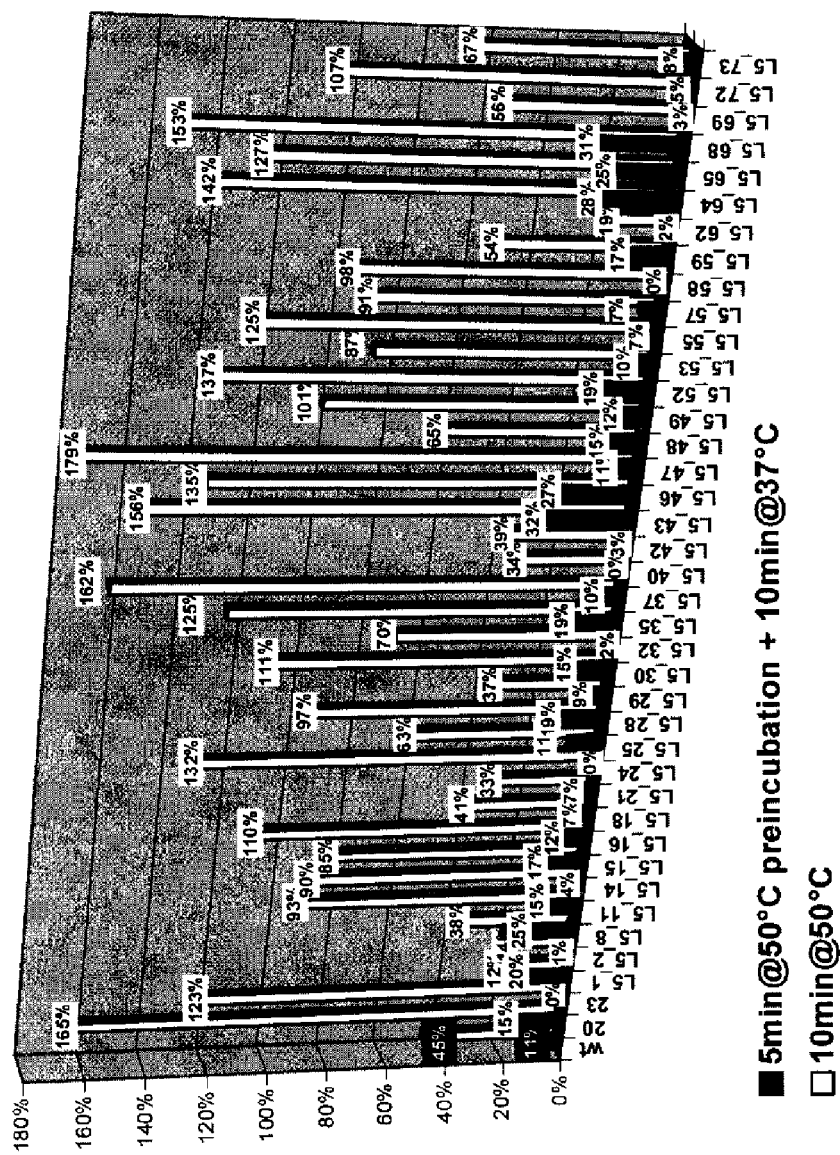

PRODUCTION OF NUCLEIC ACID

This application is a Continuation of U.S. patent application Ser. No. 12/899,641, filed on Oct. 10, 2010, and PCT/EP2009/054329 filed Apr. 9, 2009, the disclosures of each incorporated by reference in its entirety.

FIELD OF INVENTION

The present invention relates to a process for the production of nucleic acid encoding a target protein and target protein obtainable thereby, including enzymes such as nucleic acid processing enzymes, and in particular reverse transcriptase.

BACKGROUND OF THE INVENTION

Protein evolution is a known technology for selection and directed evolution of proteins from large libraries. The basic principle of selection is to ensure that there is a linkage between a specific phenotype (protein) and its encoding, genotype. This phenotype-genotype linkage can be realized in three different ways:
- covalent linkage such as mRNA display, and to some extent phage display, bacterial display, yeast display etc.,
- non-covalent linkage which use affinity interaction. Examples are ribosome display, CIS display, plasmid display etc.,
- compartmentalization such as in vitro compartmentalisation (IVC), compartmentalized self-replication (CSR), simple bacterial screening, high throughput screening etc.

As indicated in the above paragraph, one example of covalent phenotype-genotype linkage is achieved using mRNA display. As described by Roberts and Szostak (1997) covalent fusions between an mRNA and the peptide or protein that it encodes can be generated by in vitro translation of synthetic mRNAs that carry puromycin, a peptidyl acceptor antibiotic, at their 3' end.

Non-covalent linkage between phenotype and genotype can be achieved with ribosome display. In ribosome display, an array of RNAs including one or more encoding a target protein is subjected to an in vitro translation system so as to form a non-covalent ternary complex of ribosome, mRNA and protein coupled to tRNA. This array of ternary complexes must be stabilized. Accordingly, each ternary complex formed during in vitro translation uses mRNA lacking a STOP codon at the end. The ternary complexes are further stabilized at low temperature (4° C.) and high concentration of magnesium (50 mM). In the stable complex the linkage between phenotype and genotype is preserved. A selection step follows whereby target protein is selected on the basis of a property of the protein whilst still attached to the ternary complex. Selected ternary complexes may then be disassembled and the mRNA associated with the target protein is amplified by RT-PCR.

In general, ribosome display is successfully applied for the selection of peptides (Mattheakis et al., 1994; Matsuura and Pluckthun, 2003) and proteins (Hanes and Pluckthun, 1997; He and Taussig, 1997; Irving et al., 2001), which bind to different targets. In some cases it is possible to use ribosome display to select for enzymatic activities, performing affinity selection of proteins with suicide inhibitor (Amstutz et al., 2002) or active site ligand (Takahashi et al., 2002).

In in vitro compartmentalization (IVC) phenotype and genotype linkage is realized by in vitro compartmentalization of genes in a water-in-oil emulsion. The number of genes used to prepare the emulsion is calculated such that most of water compartments contain no more than a single gene. The compartmentalized genes are transcribed and translated. The activity of the synthesized proteins is then assessed. Subsequent selection on the basis of protein activity results in amplification of DNA encoding active proteins with desired properties. Water droplets used in most IVC applications are 2-3 μm in size, giving ~5 femtoliters reaction volume and ~$10^{10}$ water-in-oil compartments (50 μl water phase) per 1 ml of emulsion. The first successful example of IVC selection system was based on target-specific DNA methylation activity (Tawfik and Griffiths, 1998). Genes of HaeIII methyltransferase were compartmentalized, transcribed and translated. In vitro synthesized methyltransferase in the presence of a cofactor was able to methylate its own DNA. Based on methylated DNA (reaction product) resistance to digestion with HaeIII restriction endonuclease, genes encoding methyltransferase were selected from a $10^7$ fold excess of other DNA molecules.

To date many more modifications of IVC have been designed and realized. The easiest way to perform IVC selection is to use DNA-modifying enzymes, in particular DNA-methyltransferases (Lee et al., 2002; Cohen et al., 2004). A similar experimental strategy was applied in order to select for active variants of FokI restriction endonuclease (Doi et al., 2004). Compartmentalized DNA, encoding active restriction endonucleases, was digested and selected by subsequent incorporation of biotin-dUTP and binding to streptavidin beads.

A different IVC selection strategy was applied for evolution of DNA polymerases (Ghadessy et al., 2001; Ghadessy et al., 2004; Ong et al., 2006). This new selection method is based on 'compartmentalized self-replication' (CSR) of genes encoding active DNA polymerase. Contrary to usual IVC, where proteins of interest are expressed in situ, CSR is performed by compartmentalization of bacterial cells expressing thermophilic DNA polymerase. Cells resuspended in PCR buffer, supplemented with primers and dNTP's, are emulsified yielding compartments ~15 μm in size. Each water droplet serves as a separate PCR compartment. During the initial PCR denaturation step the bacterial cells are broken releasing the expressed thermophilic DNA polymerase and its encoding gene into the reaction mixture, allowing self-replication to proceed meanwhile other bacterial proteins are denatured by high temperature.

A modification of IVC is the use of double water-in-oil-in-water emulsions. Water droplets surrounded by an oil layer can be analyzed and sorted in a FACS at a rate of >$10^4$ variants per second (Bernath et al., 2004; Mastrobattista et al., 2005).

Selection of proteins for binding may also be performed by IVC. A protein of interest expressed in water-in-oil compartments is coupled covalently (Bertschinger and Neri, 2004) or non-covalently (Doi and Yanagawa, 1999; Yonezawa et al., 2003; Sepp and Choo, 2005) to the gene that encodes it.

Other applications of IVC are known where microbeads entrapped into compartments are used as intermediators for protein and gene coupling. Single genes attached to microbeads are transcribed and translated in water droplets. Newly synthesized protein is captured onto the same bead within reaction compartment. After emulsion is broken isolated beads can be used further for affinity selection (Sepp et al., 2002). Emulsions usually are broken using organic solvents (hexane, ether, chloroform), which can also decrease activity of certain enzymes displayed on the beads, limiting the application of this technology. For selection of catalytic activity microbeads can be easily washed, resuspended in different reaction buffer and compartmentalized again by second emulsification step (Griffiths and Tawfik, 2003). However sometimes rigid enzyme-bead-gene complexes (because of sterical hindrance and enzyme mobility limitations) can not fulfil essential reaction requirements and the activity of the attached enzymes may be lower than that of the free enzyme. In addition, such methods are technically complicated since many additional components have to be used (i.e. affinity tags, antibodies, and beads).

The composition of emulsions used in IVC is designed to ensure stability of water compartments and efficient in vitro transcription of mRNA and subsequent translation of target proteins. In vitro evolution has a broad range of targets to be improved. Some proteins and enzymes of interest are robust hard-workers and can be active enough in different buffers, in particular in reaction mixtures used in IVC. However there are many complicated enzymes, which can work only under optimized or specific conditions. In addition to that the first law of in vitro evolution says—"you will evolve what you are selecting for". That means, an enzyme evolved and optimized in transcription/translation reaction mixture will work well in that particular mixture and most likely will perform much worse in its own buffer. In some cases enzyme working conditions are incompatible with in vitro transcription and translation mixture used for protein expression in compartments. A partial solution is a nano-droplets delivery system (Bernath et al., 2005) used to transport different solutes into emulsion compartments. Even more sophisticated manipulations with water-in-oil compartments can be done employing microfluidics devices. Highly monodisperse single or double emulsions (Thorsen et al., 2001; Okushima et al., 2004) can be prepared at a rate of up to 10000 aqueous droplets per second. Generated water compartments can be transported in microfluidic channels, fused, subdivided and sorted (Song et al., 2003; Link et al., 2006). Nevertheless full buffer exchange in the compartments is still a problem.

Reverse transcriptases are very important commercial enzymes used to synthesize cDNA from an mRNA target. A lot of research has been done in order to improve properties of reverse transcriptases. However no properly working selection system suitable for in vitro evolution of reverse transcriptase was known to date. Almost all improvements are made and mutants of reverse transcriptase selected using high throughput screening and rational design.

Neither ribosome display (RD), nor in vitro compartmentalization (IVC) may be used for selection of fully active reverse transcriptase. Ternary complexes used in ribosome display usually are not stable at higher temperatures required to perform reverse transcriptase selection and as a consequence linkage between phenotype and genotype will be lost. Whilst relatively stable ternary complexes used in ribosome display can be produced using synthetic in vitro translation extract WakoPURE (Matsuura et al., 2007), in vitro translated reverse transcriptase immobilized to ribosome and mRNA will encounter significant steric hindrance during synthesis of full-length cDNA. There is also the possibility that immobilized enzyme will act in trans as well as in cis, which again is incompatible with protein evolution strategy, because the phenotype-genotype linkage will not be preserved.

IVC generally employs DNA as genetic material. In vitro transcription of mRNA and target protein translation is performed in spatially separated emulsified water compartments in the presence of the DNA. In the case of reverse transcriptase in vitro evolution, the presence of coding DNA sequence abolishes the main prerequisite of selection for reverse transcriptase activity—cDNA has to be synthesized de novo. In other words, selection for better reverse transcriptase variants is based on enzyme ability to synthesize their own coding cDNA from mRNA. Newly synthesized cDNA has to be amplified by PCR, therefore cDNA should be the only source of DNA in the reaction. DNA used in IVC selection will amplify together with cDNA canceling basic selection scheme.

More sophisticated variants of in vitro compartmentalization, such as usage of microbeads entrapped in water compartments (Sepp et al., 2002; Griffiths and Tawfik, 2003), allow complete exchange of reaction buffer. In this approach the phenotype-genotype linkage is realized via microbeads yielding a rigid selection unit mRNA-microbead-protein, which, in case of reverse transcriptase selection, again can cause steric hindrance and as a result inefficient cDNA synthesis.

Taq DNA polymerase able to synthesize ~300 nucleotides long cDNA was selected using modification of phage display technology (Vichier-Guerre et. al, 2006). Although this approach works, it has some shortcomings: 1) not all proteins can be displayed on phages; 2) absolute requirement to use biotin labeled nucleotides for selection; 3) displayed enzyme can work in trans as well as in cis; 4) because of steric hindrance and enzyme mobility limitations phage-enzyme-DNA/RNA complex can interfere with efficient synthesis of cDNA.

The possibility of selection for reverse transcriptase is also mentioned in WO0222869, which is related to the compartmentalized self-replication (CSR) method. CSR technology is used to select thermophilic DNA polymerases, in particular Taq DNA polymerase (Ghadessy et al., 2001; Ghadessy et al., 2004; Ong et al., 2006). Bacterial cells, expressing mutants library of thermophilic DNA polymerase are suspended in PCR mixture and emulsified yielding separate PCR compartments for in vitro selection of more active polymerases.

Real selection for reverse transcriptase activity will be prevented by the presence of bacterial RNases, which remain active at moderate temperatures and will degrade target mRNA. There will also be DNA contamination from non-selected plasmid DNA (released from bacterial cell) as well as the presence of all $E.$ $coli$ enzymes, structural proteins, ribosomes, NTP, RNases, DNases and small molecular weight molecules.

SUMMARY OF THE INVENTION

The present invention aims to provide an improved method of protein evolution which does not suffer from drawbacks of the prior art methods.

Accordingly, in a first aspect, the present invention provides a process for the production of nucleic acid encoding a target protein, which comprises:
- (a) providing an array of RNA or DNA molecules including one or more encoding the target protein;
- (b) generating a target protein from the array to form RNA-protein or DNA-protein complexes in which the RNA or DNA molecule is non-covalently or covalently bound to the complex;
- (c) separating the complexes into compartments wherein most or all of the compartments contain no more than one complex;
- (d) subjecting the complexes to reaction conditions which allow target protein activity; and
- (e) selecting nucleic acid encoding the target protein on the basis of the activity associated therewith, wherein when the complex is a DNA-protein complex in which the DNA is non-covalently bound, step b) is performed in the absence of separate compartments for each complex.

The present inventors have devised a method which utilizes two distinct types of phenotype-genotype linkage and achieves a new selection system for use in methods of protein evolution within the laboratory.

The new features of the method, described further below, allow it to be applied to an extended range of target proteins in comparison to the methods of the prior art, with increased ease of use and flexibility. In particular, the present invention provides for the first time the possibility of evolving and improving the properties of reverse transcriptase enzymes—one of the most important enzyme groups in the toolbox of molecular biologists.

In one embodiment of this aspect the invention provides a process for the production of nucleic acid encoding a target protein, which comprises:

(a) providing an array of RNA or DNA molecules including one or more encoding the target protein;

(b) generating a target protein from the array to form RNA-protein or DNA-protein complexes;

(c) separating the complexes into compartments wherein most or all of the compartments contain no more than one complex;

(d) subjecting the complexes to reaction conditions which allow target protein activity; and (e) selecting nucleic acid encoding the target protein on the basis of the activity associated therewith, wherein in the RNA-protein complex the RNA is non-covalently or covalently bound thereto and in the DNA-protein complex the DNA is covalently bound thereto.

In a second embodiment of this aspect the invention provides process for the production of nucleic acid encoding a target protein, which comprises:

(a) providing an array of RNA or DNA molecules including one or more encoding the target protein;

(b) generating a target protein from the array to form RNA-protein or DNA-protein complexes in which the RNA or DNA molecule is non-covalently or covalently bound to the complex;

(c) separating the complexes into compartments wherein most or all of the compartments contain no more than one complex;

(d) subjecting the complexes to reaction conditions which allow target protein activity; and (e) selecting nucleic acid encoding the target protein on the basis of the activity associated therewith, wherein step b) is performed in the absence of separate compartments for each complex.

Covalent linkages between DNA or RNA and the target protein can be generated by any technique known in the art, for example, mRNA display, phage display, bacterial display or yeast display. In particular, a covalent RNA-protein linkage can be generated using the technique of mRNA display, while a covalent DNA-protein linkage can be generated using the technique of covalent antibody display (CAD) (Reiersen et al., 2005), performing translation in compartments by covalent DNA display (Bertschinger and Neri, 2004), or using similar covalent display techniques such as those described by Stein et al., (2005).

Non-covalent linkages between DNA or RNA and the target protein can also be generated by any technique known in the art, for example, ribosome display, CIS display, or plasmid display. In particular, a non-covalent DNA-protein linkage can be generated in the absence of a compartment using CIS display (Odergrip et al., 2004), while a non-covalent RNA-protein linkage can be generated using the technique of ribosome display.

As indicated above, when the complex is a DNA-protein complex in which the DNA is non-covalently bound, step (b) of the process of the invention is performed in the absence of separate compartments for each complex. In other words, step (b) is un-compartmentalised. Specifically, when the complex generated is a DNA-protein complex in which the DNA is non-covalently bound, the generation step is performed without separating each member of the array from one another. In particular, the generation step is performed without separating each member of the array by in vitro compartmentalization (IVC). In a particularly preferred embodiment the generation step is performed without separating each member of the array in a water-in-oil emulsion.

Compartmentalisation can also be performed by any method known in the art which enables the complexes to be generated or separated such that all or substantially all of the compartments contain no more than one complex. In particular, it is preferred, that at least 70%, at least 80% or at least 90% of the compartments contain no more than one complex. For example, compartmentalization can be performed by separating members of the array or each complex into different wells on a microtitre or nanotitre plate, or by in vitro compartmentalization (IVC). In particularly, separation by IVC can involve separation into aqueous droplets in a water-in-oil emulsion or a water-in-oil-in-water emulsion.

The method of the present invention combines at least two different types of genotype-phenotype linkage selected from the list covalent linkage, non-covalent linkage and compartmentalization. In a preferred aspect of the invention the method utilized no more than two of these linkages. Thus in a particularly preferred embodiment the method utilizes the covalent or non-covalent linkage as the only genotype-phenotype linkage in step b). In other words, in this embodiment there is no compartmentalization in step b).

Covalent/non-covalent linkages between DNA or RNA and the protein in the absence of a compartment can be established in many different ways, for example, by ribosome display, mRNA display (Roberts and Szostak, 1997), CIS display (Odergrip et al., 2004) or covalent antibody display (CAD) (Reiersen et al., 2005). Specifically, covalent DNA-protein linkage can be realized in the absence of compartments by using CAD technique, while covalent RNA-protein linkage and non-covalent RNA-protein linkage can be established by mRNA display and ribosome display, respectively.

The present invention can be realized through a combination of many different linkages. For example, the present invention can be realized through a combination of ribosome display and in vitro compartmentalization, or through a combination of mRNA display, CIS display, or CAD display and IVC.

In a preferred aspect the process for the production of nucleic acid encoding a target protein is realized through a combination of ribosome display and in vitro compartmentalization. In particular such an process comprises:

(a) providing an array of mRNAs including one or more encoding the target protein;

(b) incubating the array of mRNAs under conditions for ribosome translation to generate an array of ternary complexes each comprising an mRNA, a ribosome and protein translated from the mRNA;

(c) incorporating the array of ternary complexes into aqueous phase droplets of a water-in-oil or a water-in-oil-in-water emulsion, wherein most or all of the aqueous phase droplets contain no more than one ternary complex;

(d) subjecting the aqueous phase droplets to reaction conditions which allow protein activity; and (e) selecting nucleic acid encoding the target protein on the basis of the enzyme activity associated therewith.

Such a process according to the present invention may be termed "compartmentalized ribosome display" (CRD). CRD is applicable to a wide range of target proteins, including enzymes. CRD has the advantage that the linkage between the enzyme and the mRNA is non-covalent. Thus if the reaction conditions used in step (d) involve a raised temperature the ternary complexes generated in step (b) will fall apart and the enzyme will be released. This avoids the problems associated with enzyme mobility described above for prior art methods in which the enzyme is immobilized on a bead.

Emulsion droplets with ribosome display complexes inside can be sorted or selected in step (e) in many ways. Preferably they are sorted by fluorescence activated cell sorting (FACS) or using microfluidic techniques. Both techniques mainly exploit fluorescence based droplet sorting. However, droplets can also be separated by size, light diffraction or light absorption, depending on the reaction conditions used in step (d) and the protein activity that is being selected for.

Fluorescent based sorting methods are preferably used when the target protein is an enzyme. In this embodiment the reaction conditions employed in step (d) include a non-fluorescent substrate capable of being converted to a fluorescent product. Activity by the enzyme generates the fluorescent product, allowing FACs to be used to distinguish between fluorescent droplets containing an active enzyme and non- or less fluorescent droplets which contain no active enzyme or a less active enzyme.

In particular, CRD is applicable to nucleic acid processing enzymes such as reverse transcriptases, and allows for fast and efficient in vitro evolution.

In a further aspect the present invention provides a process for the production of nucleic acid encoding a target protein, which comprises:

(a) providing an array of mRNAs including one or more encoding the target protein, wherein the mRNAs comprise a substrate for an enzyme comprising the target protein or a co-enzyme thereof;

(b) incubating the array of mRNAs under conditions for ribosome translation to generate an array of ternary complexes each comprising an mRNA, a ribosome and protein translated from the mRNA;

(c) incorporating the array of ternary complexes, and optionally the co-enzyme, into aqueous phase droplets of a water-in-oil or a water-in-oil-in-water emulsion, wherein most or all of the aqueous phase droplets contain no more than one ternary complex;

(d) subjecting the aqueous phase droplets to reaction conditions which allow enzyme activity; and (e) selecting nucleic acid encoding the target protein on the basis of the enzyme activity associated therewith.

In one embodiment of this aspect of the invention, where the nucleic acid processing enzyme is a DNA dependent DNA polymerase, the mRNA of step (a) can be ligated to a double stranded DNA adaptor molecule to provide the substrate.

CRD diversity is ~$10^9$-$10^{10}$ variants and is limited by IVC step. The new method is much more efficient, less time consuming and cheaper compared to high throughput screening (HTS), which can be used to screen ~$10^5$-$10^6$ mutant variants of reverse transcriptase. CRD diversity is about four orders of magnitude higher compared to HTS; thus many more beneficial mutants missed by HTS can be easily fished-out by compartmentalized ribosome display selection.

According to step (a), an array of mRNAs which are typically synthesized mRNAs is provided which includes one or more members of the array encoding the target protein.

Where the target protein is reverse transcriptase the mRNAs comprise a substrate for an enzyme comprising the target protein or a co-enzyme thereof. In the subsequent selection step (e), the nucleic acid encoding the target protein is selected on the basis of the enzyme activity associated therewith. In this way, two embodiments of the invention are contemplated: one in which the enzyme activity is provided by the target protein and one in which the enzyme activity is provided by a co-enzyme of the target protein in the presence of the target protein. In the embodiment requiring the co-enzyme, this is incorporated into aqueous phase droplets of the water-in-oil emulsion of step (c), as is the array of ternary complexes. Where the enzyme comprises the target protein, no additional co-enzyme need to be incorporated into the aqueous phase droplets.

In step (b) of the process, the array of mRNAs is treated with ribosomes to generate an array of ternary complexes, each comprising an mRNA, a ribosome and protein translated from the mRNA. This step may be performed under any conditions suitable for typical in vitro translation of mRNA, as used for example in the technique of ribosome display. At this point, the ternary complexes may be purified, although this is not essential. The ternary complexes may be supplemented at this point with any co-substrates necessary for the subsequent enzyme activity whereupon the reaction mixture is typically emulsified to give approximately $10^{10}$ water-in-oil compartments each typically having a mean diameter of approximately 2 to 3 µm. Even a small volume (25 µl) of in vitro translation reaction generates approximately $10^{11}$ to $10^{12}$ molecules of stored ribosomal complexes. A typical ribosome display method uses mRNAs lacking STOP codons, although STOP codon may be present (Matsuura et al., 2007). In order to achieve aqueous phase droplets in which most or all contain no more than one ternary complex the concentration of ternary complexes would have to be reduced by about two orders of magnitude as compared with corresponding concentration used in a typical ribosome display technique. Only a very small concentration of ternary complexes is used in this step of the process.

The enzyme may comprise a nucleic acid processing enzyme, which may be an RNA processing enzyme. The nucleic acid processing enzyme may comprise the target protein and may be selected from a nucleic acid polymerase, a nucleic acid ligase and a terminal deoxynucleotidyl transferase. As described in further detail herein, the nucleic acid polymerase may comprise a reverse transcriptase. In this embodiment, the mRNA encoding the reverse transcriptase is itself the substrate for the reverse transcriptase. Step (e) of selecting nucleic acid encoding the target protein, comprises selecting cDNA produced by the action of the reverse transcriptase, which cDNA encodes reverse transcriptase.

Where the target protein is a nucleic acid ligase, selection for RNA (DNA) ligases able to ligate RNA to RNA or DNA to RNA can be performed. Preferably, the reaction conditions which allow enzyme activity include a co-substrate comprising a nucleic acid linker or adaptor, which co-substrate further comprises an affinity ligand for attachment to a ligand binding partner or sequence tag for specific amplification of processed mRNA in RT-PCR. In the first case, the mRNA encoding the target protein is ligated to the co-substrate in those aqueous phase droplets which incorporate mRNA encoding a nucleic acid ligase. Preferably, the affinity ligand comprises biotin and the ligand binding partner comprises streptavidin. The step of selecting nucleic acid encoding the target protein comprises selecting mRNA incorporating the co-substrate by attachment to a solid phase comprising the ligand binding partner. In a typical process, a mutant library of ligase is translated in vitro and purified ternary complexes are diluted and emulsified in reaction buffer with biotin labeled DNA/RNA linker and/or adaptor. After bringing the emulsion to a temperature of 37° C. ribosome ternary complexes disassemble. Ligase will be released and the 3' end of the mRNA will become accessible for the biotin labeled adaptor and subsequent ligation reaction. Biotin labeled mRNA encoding only active (or more active) variants of ligase will be purified on the streptavidin beads and may be amplified by RT-PCR.

In the second case the step of selecting nucleic acid encoding the target protein comprises selecting mRNA with attached sequence specific tag, which can be used for selective annealing site of primer for reverse transcription and subsequent PCR.

In a typical process, a mutant library of ligase is. translated in vitro and purified ternary complexes are diluted and emulsified in reaction buffer with DNA/RNA linker and/or adaptor. After bringing the emulsion to a temperature of 37° C. ribosome ternary complexes disassemble. Ligase will be released and the 3' end of the mRNA will become accessible for the adaptor and subsequent ligation reaction. RNA encoding only active (or more active) variants of ligase will have specific linker sequence required for specific annealing of primer used in reverse transcription and may be efficiently amplified by RT-PCR.

It is also possible to select for terminal deoxynucleotidyl transferase (TdT). This enzyme works on RNA and incorporates deoxyribonucleotides, ribonucleotides, nucleotide analogues and similar. In this embodiment, the reaction conditions which allow enzyme activity include a co-substrate comprising dNTP which further comprises an affinity ligand for attachment to a ligand binding partner. As with the nucleic acid ligase, the affinity ligand may be biotin and the ligand binding partner streptavidin. Selecting nucleic acid encoding the target protein may comprise selecting mRNA incorporating the co-substrate by attachment to a solid phase comprising the ligand binding partner. A mutant library of TdTs may be translated in vitro and purified ribosome ternary complexes may have to be diluted and emulsified in reaction buffer with biotin labeled nucleotides, such as biotin-dUTP. The optimal working temperature for wild type enzyme is 37° C. At this temperature the ribosome ternary complexes will disassemble and the 3' end of mRNA will become accessible for template independent polymerization reaction. TdT-encoding mRNA incorporating biotin labeled nucleotide is selected on the streptavidin beads and may subsequently be reversed transcribed and amplified by RT-PCR.

In a further embodiment, the target protein comprises a reverse transcriptase helper enzyme such as a helicase, pyrophosphatase, processivity factor, RNA binding protein or other protein able to improve a reverse transcription reaction in the presence of reverse transcriptase. In this embodiment, the nucleic acid processing enzyme comprises a reverse transcriptase, which is the co-enzyme incorporated into the aqueous phase droplets of the water-in-oil emulsion. In step (c) of selecting nucleic acid target protein; cDNA is selected, which cDNA is produced by the action of the reverse transcriptase and which encodes the reverse transcriptase helper enzyme. The presence of the reverse transcriptase helper enzyme in the aqueous phase facilitates reverse transcription of the mRNA which encodes the helper. Thus, mRNA which is reverse transcribed forms cDNA which encodes the helper and this may be PCR amplified.

In a further embodiment, the target protein comprises an RNase inhibitor. In this embodiment, the nucleic acid processing enzyme comprises an RNase. The step (e) of selecting nucleic acid encoding the target protein comprises selecting mRNA undegraded by RNase. In this embodiment, the RNase is incorporated as the co-enzyme into the aqueous phase droplets of the water-in-oil emulsion. Once reaction conditions allow enzyme activity, any droplets not containing effective RNase inhibitor would exhibit RNase activity whereby the mRNA would be degraded. Thus, mRNA encoding RNase inhibitor effective at the reaction conditions used would survive. Typically, a mutant library of RNase inhibitors is translated in vitro and purified ribosome ternary complexes are diluted and emulsified in reaction buffer with appropriate RNase. In an alternative arrangement RNase can be delivered later by emulsion micro droplets. mRNA encoding only active (or more stable) RNase inhibitor will be purified and amplified by RT-PCR.

Compartmentalized ribosome display can also be used for reaction buffer exchange in in vitro compartmentalization where selection buffer is incompatible with in vitro translation mixture and substrate conversion to product has to be performed under strictly controlled reaction conditions.

The nucleic acid encoding the target protein which has been selected on the basis of the enzyme activity associated therewith may be DNA or RNA, as discussed herein. The array may be converted or amplified to form DNA or RNA. In a preferred arrangement, the array is converted or amplified to form the array of mRNAs of step (a) of the process and is subject to one or more further cycles of steps (b) to (e) so as to enrich further the array with increasing amounts of mRNAs encoding the target protein.

The step (d) of subjecting the aqueous phase droplets to reaction conditions which allow enzyme activity provides the basis for selection step (e) where those nucleic acids encoding the target protein are selected. A wide range of reaction conditions may be used in step (d) to provide selection pressure. In one example, the reaction conditions include a temperature above the optimum temperature for a wild type enzyme. These reaction conditions may be used to select a mutant enzyme which is more thermostable than wild type enzyme or which has a greater reaction velocity at that temperature or an altered temperature-activity profile. Mutant enzymes may have to operate at higher sensitivities than wild type enzymes because concentrations of mRNA in the aqueous phase droplets are approximately 400 pM. Mutant enzymes may also have to perform more accurately. All of these selection pressures are particularly important in relation to reverse transcriptases. As well as physical conditions, the reaction conditions may include alterations in buffer, concentrations of other factors such as metal ions and pH.

Many more different selection pressures can be applied in CRD selecting for better reverse transcriptases: 1) selection for more soluble enzymes which are less prone to aggregation—ternary complexes (before emulsification) have to be preincubated with hydrophobic material in order to eliminate proteins with surface exposed hydrophobic residues; 2) selection for very fast enzymes—reverse transcription reaction times have to be gradually reduced during selection cycles; 3) selection for enzymes synthesizing long cDNA—gradual prolongation of mRNA library used in CRD and as a consequence synthesis of longer cDNA; 4) selection for enzymes able to transcribe through secondary structures—secondary structure forming sequences have to be introduced into mRNA library used in CRD; 5) selection for enzymes working in buffers which are different from RT buffer (for example in PCR, one step RT-PCR buffer or with denaturing agents)—CRD selection has to be performed in buffer of our choice; 6) selection for enzymes able to incorporate nucleotide analogues—selection has to be performed in RT buffer with biotin labeled nucleotide analogues with subsequent cDNA purification on streptavidin beads.

Compartmentalized ribosome display (CRD) is also suitable for many fluorescence activated cell sorting (FACS) applications. Protein of interest has to be displayed in ribosome display format. Optionally purified (or just diluted many times) ternary complex comprising mRNA-ribosome-protein (tRNA) mixed with non fluorescent substrate (S) in reaction buffer should be emulsified producing double water-in-oil-in-water emulsions (Bernath et al., 2004; Mastrobattista et al., 2005). Active variants of compartmentalized enzymes will convert substrate (S) to fluorescent product (P) allowing FACS to distinguish between fluorescent (active enzyme inside) and "dark" (inactive enzyme inside) droplets. Contrary to previously published examples, where enzymatic reaction has to be performed in transcription/translation mixture, CRD allows for complete buffer exchange and selection for active enzymes in more native (required) conditions (FIG. 10.)

Selection and evolution of thermostable DNA polymerases using CRD is also possible (FIG. 11.). Polymerase of interest has to be displayed in ribosome display format. Optionally purified (or just diluted many times) ternary complex comprising mRNA-ribosome-polymerase can be used to prepare reaction mixture with reverse transcriptase (helper enzyme), dNTP's and primer set in PCR buffer. Reaction solution should be emulsified producing water-in-oil emulsion. In first RT step—reverse transcriptase has to synthesize cDNA, which subsequently will serve as a target for second PCR step—cDNA amplification by ribosome displayed DNA polymerase. One of the primers used in PCR can have biotin for optional subsequent purification with streptavidin beads and non-complementary 5' end. After RT-PCR emulsions should be broken, newly synthesized DNA fragment can be purified via biotin and reamplified using new primer set, which will contain one primer with sequence non-complementary to cDNA, but identical to 5' part of primer used in first amplification reaction (selective amplification of DNA over cDNA background). More active variants of DNA polymerase will be enriched over less active variants and can be used for further analysis or next selection-round (FIG. 11.).

Important features of the compartmentalized ribosome display technology are:
1) the genotype is maintained by an mRNA library, which is especially useful in selecting RNA processing enzymes;
2) the selection unit is a ternary complex of mRNA-ribosome-protein (tRNA) and this can readily purified by ultracentrifugation, gel-filtration, affinity tag purification and other simple means;
3) the reaction buffer can be exchanged thereby enabling the selection unit to be transferred (with or without purification) to a new reaction mixture and at the same time be diluted by a factor of 100 to 200 (in order to adjust the number of ribosome complexes after emulsification to less than one molecule per reaction compartment);
4) the mRNA library diversity of CRD is limited only by the diversity of the in vitro compartmentalization and is less than $10^{10}$ different variants;
5) once emulsified, the selection reaction can be performed at a broad range of temperatures from 4° to 94° C. because emulsions are stable over these temperatures;
6) if selections performed at elevated temperatures (30° C. and above), the ternary complexes will dissociate but remain compartmentalized so as not to lose the genotype-phenotype link, releasing mRNA and in vitro translated protein.

The compartmentalized ribosome display process of the present invention has been found to work particularly well in promoting evolution of new reverse transcriptase enzymes. As an example, M-MuLV reverse transcriptase (Gerard et al., 1986, pRT601) may be used for selection (the enzyme including a N terminal His tag for purification). This reverse transcriptase has a temperature optimum for activity at 42° C. and is active at temperatures up to 50° C. An array of mRNAs encoding the M-MuLV reverse transcriptase may be subjected in step (d) of the process of the present invention to reaction conditions which include primer and dNTPs required for cDNA synthesis at an incubation temperature in the range of from 50° C. to 60° C. At these elevated temperatures stored ribosomal complexes stable at 4° C. quickly dissociate releasing into solution a reverse transcriptase substrate (mRNA) and enzyme.

In one embodiment, in vitro translated reverse transcriptase M-MuLV released from ribosomal complex has C terminal fusion with phage lambda outer surface protein D used in ribosome display construct as a spacer to remain in ribosomal tunnel (Matsuura and Pluckthun, 2003) and covalently bound tRNA, because translation was not terminated properly. Protein D is very well expressed, soluble, stable protein with unfolding transition temperature ~57° C. (Forrer and Jaussi, 1998) and therefore is good fusion partner for selection of thermostable reverse transcriptase.

In compartmentalized ribosome display selection method only fully active variants of reverse transcriptase can perform synthesis of cDNA, which encodes the same active enzyme. In 1 hr, after the reverse transcription reaction is completed, emulsion is broken, cDNA is purified and amplified by nested PCR. Because of the selection nature of CRD only cDNA, which encodes active variants of reverse transcriptase, able to perform full length cDNA synthesis, will be amplified and if necessary transferred to the next selection round. In order to eliminate undesirable mutations in T7 polymerase promoter region, ribosome binding site (RBS) and protein D sequence, amplified DNA, encoding only M-MuLV sequence, may be ligated to native 5' and 3' terminal fragments in such way that original ribosome display construct is restored and next selection round can be performed.

In five selection rounds enzyme variants with specific activities at 50° have been identified, which are 2-4 times better as compared to the activity of the primary enzyme used for library preparation. Some of proteins are faster, some—more thermostable. Many selected M-MuLV variants have mutations D524G or D583N, which turn off RNase H activity of reverse transcriptase and improve cDNA synthesis as well as thermostability (Gerard et al., 2002). Many more variants of selected M-MuLV reverse transcriptases have other different beneficial mutations (H204R; H638R; T197A; M289V; E302K; T306A; N454K; Y64C; E69G; Q190R; V223M; F309S; L435P; E562K) mentioned and described before (U.S. Pat. No. 7,056,716; US20060094050A1; U.S. Pat. No. 7,078,208; US20050232934A1; WO07022045A2). In addition to that we have found many new hot spots in reverse transcriptase amino acids sequence. Some mutations repeat very frequently and are of very high importance, what was shown analyzing purified mutants (Example 2). Thus we can state, that our CRD technology is very fast and robust selection method, efficiency of which was confirmed by direct evolution and improvement of M-MuLV reverse transcriptase. As proof of principle we have selected variants of M-MuLV reverse transcriptase working better at higher temperatures.

In a further aspect, the present invention provides a reverse transcriptase enzyme obtainable by the process as described herein.

In a further aspect, the present invention provides a reverse transcriptase enzyme having an optimum activity at a temperature above 42° C., preferably at least 50° C. and more preferably in the range of from 50° C. to 60° C. Reverse transcriptase enzymes may be selected according to the process described herein by applying reaction conditions having an elevated temperature, preferably of at least 50° C. In this aspect of the invention, a reverse transcriptase enzyme may be selected which has an activity-temperature profile which is shifted in comparison with wild type enzyme to increase the temperature at which optimum activity is observed.

In a further aspect, the invention provides a reverse transcriptase enzyme which comprises a MMLV reverse transcriptase amino acid sequence with a mutation at one or more of the following amino acid positions:

| D200, | D653, | L603, | T330, | L139, | Q221, |
|---|---|---|---|---|---|
| T287, | I49, | N479, | H594, | F625, | H126, |
| A502, | E607, | K658, | P130, | Q237, | N249, |
| A307, | Y344, | Q430, | D449, | A644, | N649, |
| L671, | E673, | M39, | Q91, | M66, | W388, |
| I179 | E302 | L333 | R390 | Q374 and | E5 |

Where the mutation is at D653 it is preferred that the mutation is not D653N. Where the mutation is at L603 it is preferred that the mutation is not L603A. Further, where the mutation is at H594 it is preferred that the mutation is not H594A.

It is preferred that the mutations at the above positions are point mutations.

Preferably, the reverse transcriptase has one or more of the following mutations:

| D200N, A or. G, | D653N, G, A, H or, V, | | L603W or M, T330P, L139P, Q221R. | | |
|---|---|---|---|---|---|
| T287A, H126S or R. | I49V or T. | N479D, | H594R or Q, | | F625S or L, |
| A502V, A307V, N649S, | E607K, G or A, Y344H, | K658R or Q Q430R, | P130S, D449G or A, | Q237R, M66L, | N249D, A644V or T, |
| L671P, | E673G or K, | M39V or L, | Q91R or L, | | W388R, |
| I179I or V | E302K | L333Q | R390W | Q374R and E5K | |

Each of these mutations is found, for example, in mutant enzymes having a higher activity at 50° C. as compared with the corresponding wild type enzyme. Further details of these mutations are described in the specific examples.

In particularly preferred aspect of the invention the mutant enzyme has at least two mutations. In one embodiment the two mutations are at D200 and at L603. For example the mutations are D200N and L603W. In an alternative embodiment the mutations are at N479 and H 594. For example the mutations are N479D and H594R.

In a further aspect, the invention provides a reverse transcriptase enzyme having an optimum activity at a temperature above 37° C., wherein the activity at 50° C. is at least 120% of the activity at 37° C. Preferably, the activity at 50° C. is at least 130%, more preferably at least 160% of the activity at 37° C.

In a further aspect, the present invention provides a mutant reverse transcriptase enzyme having an activity at 50° C. which is at least twice that of the corresponding wild type enzyme.

In a further aspect, the present invention provides a mutant reverse transcriptase enzyme having a specific activity at 37° C. which is at least 130% of the corresponding wild type enzyme. Preferably, the specific activity of the mutant reverse transcriptase enzyme is at least 140%, more preferably at least 150% and particularly preferably at least 160% of the specific activity of the corresponding wild type enzyme. It has been found as described herein that partially purified wild type enzyme specific activity at 37° C. is approximately 200000 U/mg. Specific mutant reverse transcriptase enzymes obtainable in accordance with the present invention are discussed in further detail in the specific examples.

In a further aspect, the present invention provides a mutant reverse transcriptase enzyme having a thermostability of at least 1.5 times that of the corresponding wild type enzyme. Thermostability is measured in the present application as residual activity at 37° C. following treatment at 50° C. for 5 minutes. Preferably, the thermostability of the mutant reverse transcriptase enzyme is at least 1.5 times, more preferably at least 2 times, still more preferably at least 2.5 times that of the corresponding wild type enzyme. Typically, residual activity at 37° C. of the wild type reverse transcriptase enzyme is approximately 11% as compared with untreated enzyme.

It is preferred that the reverse transcriptase enzyme according to the invention comprises an MMLV reverse transcriptase.

In a further aspect, the present invention provides a polynucleotide, such as an mRNA or DNA, encoding a reverse transcriptase as described herein.

The reverse transcriptases according to the present invention may be used in a variety of molecular biology techniques such as RT-PCR (qRT-PCR, etc). A kit for RT-PCR may be provided in which the reverse transcriptase of the kit is a reverse transcriptase according to the present invention.

DETAILED DESCRIPTION OF INVENTION

The invention will now be described in further detail, by way of example only, with reference to the accompanying figures and appendices:

FIG. 1. The experimental scheme of Example 1. Two plasmids pET_his_MLV_pD (encoding Moloney Murine Leukemia Virus (M-MLV) reverse transcriptase fused to protein D spacer) and pET_his_del_pD (encoding inactivated (57 amino acids deletion in pol domain) Moloney Murine Leukemia Virus (M-MLV) reverse transcriptase fused to protein D spacer) were used to synthesize PCR fragments. PCR fragments furtheron are used in transcription reaction and synthesis of mRNA lacking STOP codon at the 3' end. Purified mRNA is mixed with ratio 1:50=MLV (active RT):del (inactive RT) and used for in vitro translation reaction. During translation reaction ribosomal complex synthesizes protein and stops at the end of mRNA lacking STOP codon. Mixture of ternary complexes (TC) is purified by ultracentrifugation on sucrose cushions. Purified ternary complexes (<3*10⁹ molecules taken) already containing mRNA linked to in vitro translated MLV reverse transcriptase are used to prepare reverse transcription reaction mix supplemented with external dNTP set and primer for RT reaction. Ice-cold RT reaction mixture is emulsified giving ~1*10¹⁰ water in oil compartments ~2 μm in size. Emulsified RT reaction mixture (less than one TC (mRNA+MLV RT) per compartment is incubated for 1 hr at 42° C. in order to perform RT reaction. After the temperature of compartmentalized RT reaction mixture is raised most of TC dissociate releasing mRNA and reverse transcriptase. Successful RT reaction is performed only in compartments containing active MLV reverse transcriptase (MLV_pD) and no cDNA is synthesized in compartments with inactive reverse transcriptase (del_pD). Subsequent PCR amplifies cDNA and enrichment of active reverse transcriptase (MLV_pD) genes over inactive reverse transcriptase (del_pD) is observed.

FIG. 2. The structural scheme of pET_his_MLV_pD plasmid.

FIG. 3. Example 1—the agarose gel electrophoresis of first PCR performed on cDNA synthesized during CRD selection. Primers used: RD_Nde (SEQ ID No: 9) and pD_55 (SEQ ID No: 10). Expected length of PCR fragments was 2185 bp for MLV_pD and 2014 bp for del_pD. Amplification was analyzed on 1% agarose gel loading 10 µl of PCR mix per well.

FIG. 4. Example 1—the agarose gel electrophoresis of nested PCR for partial gene amplification performed on first PCR product. Primers used: M_F (SEQ ID No: 11) and M_2R (SEQ ID No: 12). Expected length of PCR fragments was 907 bp for MLV_pDa and 736 bp for del_pD. Amplification was analyzed on 1% agarose gel loading 10 µl of PCR mix per well.

FIG. 5. Example 1—the agarose gel electrophoresis of nested PCR for full gene amplification performed on first PCR product. Primers used: M_Esp (SEQ ID No: 13) and M_Eri (SEQ ID No: 14). Expected length of PCR fragments was 2077 bp for MLV_pDa and 1906 bp for del_pD. Amplification was analyzed on 1% agarose gel loading 10 µl of PCR mix per well.

FIG. 6. The experimental scheme of CRD selection in Example 2. PCR fragments encoding mutants library of reverse transcriptase (in fusion with protein D) MLV_pD was used to synthesize mRNA. Purified mRNA was used for in vitro translation reaction. Ternary complexes (TC) of mRNA-ribosome-MLV_pD (tRNA) were formed in translation mixture and stabilized by low temperature and high concentration of $Mg^{2+}$ ions. Mixture of TC was purified by ultracentrifugation on sucrose cushions. Precipitated TC was dissolved in ice-cold buffer (50 mM $Mg^{2+}$) and used to prepare reverse transcription reaction mix supplemented with external dNTP set and primer for RT reaction. Ice-cold RT reaction mixture was emulsified giving ~$1*10^{10}$ water in oil compartments ~2 µm in size. Optimal reaction temperature of MLV RT is ~42° C. In order to select for reverse transcriptase variants, which are working better at higher temperatures emulsified RT reaction mixture (less than one TC (mRNA+MLV RT) per compartment) was incubated for 1 hr at 50° C. At this temperature successful synthesis of full length cDNA was performed better in compartments containing more active or thermostable MLV reverse transcriptase variants. Subsequent PCR was used to amplify full length cDNA and enrichment of more active and thermostable reverse transcriptase genes was performed. By PCR amplified genes were moved back to CRD format restoring intact 5' (START fragment—T7 polymerase promoter, SD and his-tag coding sequences) and 3' (END fragment—gs linker, protein D and second gs linker) sequences by ligation PCR. Reconstructed PCR fragment, containing enriched library of reverse transcriptase genes, was used for subsequent mRNA transcription and next CRD selection round. Each selection round was performed at higher and higher temperatures of RT reaction: 50° C. ($1^{st}$ round); 52.5° C. ($2^{nd}$ round); 55° C. ($3^{rd}$ round); 57.5° C. ($4^{th}$ round) and 60° C. ($5^{th}$ round).

FIG. 7. The scheme of PCR fragment reconstruction before new round of CRD selection. Mutated MLV RT library was digested with Esp3I (NcoI compatible end) and EcoRI and ligated with START (244 bp) and END (398 bp) fragments in order to get PCR fragment suitable for CRD selection. START fragment (containing T7 polymerase promoter, SD and his-tag coding sequences) was constructed by PCR amplification of initial 983 bp START fragment (target—plasmid pET_his_del_pD (SEQ ID No: 2), primers—pro-pIVEX (SR) ID No: 3) and M_1R (SEQ ID No: 15)) and subsequent digestion with NcoI (recognition sequence C↓CATGG) giving 244 bp DNA fragment. END fragment (containing gs linker, protein D and second gs linker sequences) was constructed by PCR amplification of initial 1039 bp END fragment (target—plasmid pET_his_del_pD (SEQ ID No: 2), primers—M_3F (SEQ ID No: 16) and pD-ter (SEQ ID No: 4)) and subsequent digestion with EcoRI (recognition sequence G↓AATTC) giving 398 bp DNA fragment.

FIG. 8. Reverse transcriptase activities of mutant RT variants measured at 37° C., 50° C. and residual activity at 37° C. after 5 min incubation at 50° C. Reverse transcriptase activity at 37° C. is normalized to be always 100% and is omitted. Thus only two types of columns (percents of RT activity at 50° C. and residual RT activity at 37° C. after 5 min incubation at 50° C.) are shown. As a control is given wt M-MuLV reverse transcriptase used for mutants library construction. This primary enzyme is expressed in the same vector and purified in the same way as mutant variants of RT. An average value of mutant RT activity at 50° C. for all tested mutants is about ~92% and is more than 2 times higher comparing to wt enzyme (45%). An average residual activity of mutant RT variants at 37° C.⁻ after 5 min preincubation at 50° C. is 12% (wt enzyme—11%).

FIG. 9. Specific activity (u/mg of protein) of partially purified wt and mutant RT variants measured 10 min at 37° C.

FIG. 10. The proposed experimental scheme of CRD selection using FACS. Protein of interest is displayed in ribosome display format. Purified (or just diluted many times) ternary complex comprising mRNA-ribosome-protein (tRNA) is mixed with non fluorescent substrate (S) in reaction buffer and subsequently emulsified producing double water-in-oil-in-water emulsions. Active variants of compartmentalized enzymes will convert substrate (S) to fluorescent product (P) allowing FACS to distinguish between fluorescent (active enzyme inside) and "dark" (inactive enzyme inside) droplets.

FIG. 11. The proposed experimental scheme for selection and evolution of thermostable DNA polymerases using CRD. Polymerase of interest has to be displayed in ribosome display format. Optionally purified (or just diluted many times) ternary complex comprising mRNA-ribosome-polymerase can be used to prepare reaction mixture with reverse transcriptase (helper enzyme), dNTP's and primer set in PCR buffer. Reaction solution should be emulsified producing water-in-oil emulsion. In first RT step—reverse transcriptase has to synthesize cDNA, which subsequently will serve as a target for second PCR step—cDNA amplification by ribosome displayed DNA polymerase. One of the primers used in PCR can have biotin for optional subsequent purification with streptavidin beads and non-complementary 5' end. After RT-PCR emulsions should be broken, newly synthesized DNA fragment can be purified via biotin and reamplified using new primer set, which will contain one primer with sequence non-complementary to cDNA, but identical to 5' part of primer used in first amplification reaction (selective amplification of DNA over cDNA background). More active variants of DNA polymerase will be enriched over less active variants and can be used for further analysis or next selection round.

FIG. 12. The experimental scheme of Example 4. In this experimental setup M-MuLV reverse transcriptase is used as DNA dependent DNA polymerase. Two plasmids pET_his_MLV_D583N_pD (encoding RNase H minus Moloney Murine Leukemia Virus (M-MLV) reverse transcriptase fused to protein D spacer) and pET_his_del_pD (encoding inactivated reverse transcriptase fused to protein D spacer—57 amino acids deletion in pol domain and point mutation D583N in RNase H domain) were used to synthesize PCR fragments. PCR fragments furtheron are used in transcription reaction. Purified mRNA is mixed with ratio 1:20=MLV_D583N_pD (active RT):del_pD (inactive RT) and used to prepare mRNA/dsDNA complex by dsDNA ligation to mRNA mix using T4 DNA ligase. mRNA/dsDNA complex was used for in vitro translation reaction. During translation reaction ribosomal complex synthesizes protein and stops at the end of mRNA (at the beginning of mRNA/DNA hybrid). Mixture of ternary complexes (TC) is purified by ultracentrifugation on sucrose cushions. Purified ternary complexes ($<3*10^9$ molecules taken) already containing mRNA/dsDNA linked to in vitro translated polymerase (M-MuLV reverse transcriptase) are used to prepare elongation reaction mix supplemented with external biotin-dUTP. Ice-cold reaction mixture is emulsified giving ~$1*10^{10}$ water in oil compartments ~2 μm in size. Emulsified elongation reaction mixture (less than one TC (mRNA/dsDNA+polymerase) per compartment is incubated for 30 min at 37° C. in order to incorporate biotinylated nucleotide. After the temperature of compartmentalized reaction mixture is raised most of TC dissociate releasing mRNA/dsDNA complex and polymerase. Successful incorporation reaction in to dsDNA substrate is performed only in compartments containing active polymerase (reverse transcriptase MLV_D583N_pD) and no cDNA is synthesized in compartments with inactive polymerase (del_pD). After the emulsions are broken excess of biotin-dUTP is removed using gel-filtration mini-column. Biotinylated mRNA/dsDNA complex is purified on streptavidin beads and used to synthesize cDNA. Subsequent PCR amplifies cDNA and enrichment of active polymerse (reverse transcriptase—MLV_D583N_pD) genes over inactive polymerase (del_pD) is observed.

FIG. 13. Determination of biotin-dUTP incorporation efficiencies into mRNA/dsDNA complex and into self primed mRNA. Picture of RT-PCR performed on samples of mRNA/dsDNA (MLV_D583N_pD) and mRNA (del_pD) after the incorporation of dTTP or biotin-dUTP. Predicted amplicons size are 907 bp for MLV_D583N_pD and 736 bp for del_pD cDNA. PCR products were analyzed on 1% agarose gel loading 10 μl of PCR mix per well.

FIG. 14. General control of mRNA/dsDNA complex existence by incorporation of dTTP (biotin-dUTP) and [α-$P^{33}$] dATP. Radioactive dATP should be introduced into dsDNA substrate subsequentially after the incorporation of initial dTTP or biotin-dUTP. A ethidium bromide visualized agarose gel (mRNA or mRNA/dsDNA bands ~2.5 kb). B—the same gel as in A dried on filter paper and visualized using Cyclone Phosphor Imager (Perkin-Elmer, Wellesley, Mass.). Labelled mRNA/dsDNA complex and/or only dsDNA bands are observed. C—structure and sequence of dsDNA counterpart in mRNA/dsDNA complex SEQ ID NOs.: 21 and 22.

FIG. 15. The resultant final RT-PCR fragments analysis of Example 4. Predicted amplicons size are 907 bp for MLV_D583N_pD and 736 bp for del_pD cDNA. PCR products were analyzed on 1% agarose gel loading 10 μl of PCR mix per well. RT-PCR samples before streptavidin beads corresponds to the ratio of active and inactive polymerase genes 1:20 (almost only delpD fragment ~736 bp is visible). RT-PCR samples after the purification on streptavidin beads corresponds to the ratio of active and inactive polymerase genes after the single selection round ~1:1. An enrichment factor of ~20 is observed in this selection.

FIG. 16. Some examples of alkaline agarose gels used to determine highest temperature of 1 kb and 4.5 kb cDNA synthesis reaction. PCR machine—Eppendor Mastercycle Gradient. A-D—1 kb cDNA synthesis (M-MuLV (wt), D200N, L603W and Q221R); temperature gradient 41.9° C., 43.6° C., 45.5° C., 47.8° C., 50.4° C., 53.1° C., 55.8° C., 58.1° C., 60.1° C., 62.1° C.; size standart—DNA Fast Ruler Middle Range (Fermentas). E-G—4.5 kb cDNA synthesis (M2, M3 and M4); temperature gradient 49.8° C., 51.5° C., 53.4° C., 55.7° C., 58.3° C., 61.0° C., 63.7° C., 66.1° C., 68.0° C., 70.0° C.; size standart—Zip Ruler Express DNA ladder 2 (Fermentas).

Appendix 1. The general scheme of mutations found in initial MLV RT library (sequence between NcoI and EcoRI restriction sites—SEQ ID No. 24). 23 nucleotide mutations were found among 10 sequenced genes (1 transversion, 20 transitions—mutated positions are underlined, mutations indicated above the sequence, 2 deletions—underlined and indicated as dashed line above the sequence) giving 15 amino acids exchanges, 6 silent mutations, 1 stop codon and 2 frame shifts of coding frame—on average 1-2 amino acids substitutions per gene.

Appendix 2. The CLUSTALW alignment of all 104 protein sequences without N terminal His tag in order to have the same numeration of amino acids as is usually used in literature. Wild type sequence denoted as MLV (SEQ ID No: 25) is always given as first sequence (mutated sequences represent SEQ ID Nos: 26 to 128 based on the order in which they are shown). Mutations are marked using white font color in black background. Amino acids positions, mutations of which somehow improve M-MuLV reverse transcriptase properties and are described in different patent applications are marked in the alignment as columns of amino acids (white font) highlighted in grey. Mutations originating from our selection and located in grey columns indicate that our selection procedure precisely targeted the beneficial hot spot or even exact amino acid mutations described elsewhere. Sequences of analyzed proteins, activity of which at 50° C. was substantially better as compared to the primary wt M-MuLV (70% and more as compared to 45% of wt activity) are highlighted in grey.

Appendix 3. List of mutations found in all selected RT variants. Proteins are sorted by decreasing number of mutations.

Appendix 4. Mutations frequency (in decreasing order) of selected RT variants. Names of analyzed proteins, which activity at 50° C. was substantially better as compared to primary wt M-MuLV (70% and more comparing to 45% of wt activity) are highlighted in grey.

Appendix 5. Summarized table of data on M-MuLV (wt) reverse transcriptase and single mutants, which contains: name of protein; selection frequency (number of sequenced mutants, which had exact mutation and the number in the parentheses indicates total number of particular amino acid mutations found in selection); protein concentration (mg/ml); reverse transcriptase specific activity at 37° C. (u/mg); relative activity at 50° C. (%); relative residual activity at 37° C. after 5 min enzyme incubation at 50° C. (%); specific RNase H activity of protein (u/mol); relative RNase H activity (%) and highest temperature of 1 kb cDNA synthesis reaction.

Appendix 6. Summarized table of data on M-MuLV (wt) reverse transcriptase and single mutants, which contains: name of protein; protein concentration (mg/ml); reverse transcriptase specific activity at 37° C. (u/mg); relative activity at 50° C. (%) and highest temperature of 1 kb and 4.5 kb cDNA synthesis reaction.

Appendix 7. Sequence and information relating to SEQ ID Nos: 1 to 23.

Example 1

CRD—Proof of Principle

To provide proof of principle for Compartmentalized Ribosome Display selection system test selection was performed. Typical proof of principle experiment should give positive signal for active enzyme (in our case RT-PCR fragment for original MLV reverse transcriptase) and no signal for inactive enzyme (no RT-PCR fragment for inactivated MLV reverse transcriptase). More sophisticated experiment is to use mixture of genes with defined ratio encoding active and inactive enzymes. As a result of successful experiment genes encoding active enzyme should be enriched over genes encoding inactive enzyme.

General scheme of experiment is shown in FIG. 1. Two plasmids pET_his_MLV_pD (encoding Moloney Murine Leukemia Virus (M-MLV) reverse transcriptase fused to protein D spacer) and pET_his_del_pD (encoding inactivated (57 amino acids deletion in pol domain) Moloney Murine Leukemia Virus (M-MLV) reverse transcriptase fused to protein D spacer) were used to synthesize PCR fragments. Further PCR fragments were used in transcription reaction for synthesis of mRNA, which lacks STOP codon at the 3' end. Purified mRNAs resulting from the two abovementioned PCR fragments were mixed with a ratio 1:50=MLV (active RT):del (inactive RT) and used for in vitro translation reaction. During translation reaction ribosomal complex synthesizes protein and stops at the end of mRNA lacking STOP codon. Translation reaction was stopped by dilution with ice-cold buffer containing 50 mM $Mg^{2+}$. Low temperature, high concentration of $Mg^{2+}$ ions and absence of STOP codon at the end of mRNA stabilize ternary complexes (TC) of mRNA-ribosome-protein (tRNA). Mixture of ternary complexes (TC) was purified by ultracentrifugation on sucrose cushions. Ultracentrifugation was optimized in such a way that TC (~3.5 MDa) were precipitated at the bottom of ultracentrifugation tube, meanwhile small molecular weight molecules, proteins and most of free mRNA (~0.9 MDa) remained in the supernatant. Precipitated TCs were dissolved in the ice-cold buffer (50 mM $Mg^{2+}$). Purified ternary complexes ($<3*10^9$ molecules taken) already containing mRNA linked to in vitro translated MLV reverse transcriptase were used to prepare reverse transcription reaction mix supplemented with external dNTP set and primer for RT reaction. Ice-cold RT reaction mixture was emulsified yielding ~$1^1 10^{10}$ water in oil compartments ~2 μm in size. Emulsified RT reaction mixture (less than one TC (mRNA+MLV RT) per compartment was incubated for 1 hr at 42° C. in order to perform RT reaction. After the temperature of compartmentalized RT reaction mixture is raised most of TCs dissociate releasing mRNA and reverse transcriptase. Successful RT reaction is performed only in compartments containing active MLV reverse transcriptase (MLV_pD) and no cDNA is synthesized in compartments with inactive reverse transcriptase (del_pD). Subsequent PCR ensures the amplification of synthesized cDNA and enrichment of active reverse transcriptase (MLV_pD) genes over inactive reverse transcriptase (del_pD) is observed.

Methods and Materials

Initial plasmid pET_his_MLV_pD (SEQ ID No: 1 and FIG. 2) was constructed by modification of pET type plasmid in T7 polymerase promoter and Shine-Dalgarno sequences region and insertion of MLV H+ reverse transcriptase coding sequence (306-2363 on SEQ ID No: 1) with N-terminal His-tag (258-305 on SEQ ID No: 1) and C-terminal fusion with glycine-serine (gs) linker (2364-2393 on SEQ ID No: 1), part of protein D (pD) from phage lambda (2394-2669 on SEQ ID No: 1) and second glycine-serine (gs) linker (2670-2759 on SEQ ID No: 1). N-terminal His-tag is used for protein express purification. C-terminal fusion has to remain in ribosome tunnel during protein in vitro translation and formation of mRNA-ribosome-MLV (tRNA) ternary complex.

M-MuLV reverse transcriptase has two main enzymatic activities: RNA dependent DNA polymerase and RNase H. Reverse transcriptase RNase H activity was turned off introducing point mutation D583N (single nucleotide G to A exchange at position 2055 in plasmid pET_his_MLV_pD, SEQ ID No: 1). Aspartate 583 is located in RNase H active site, is involved in Mg ion binding and is crucial for RNase H activity. New plasmid is identified as pET_his_MLV_D583N_pD and was used for further construction of next plasmid pET_his_del_pD (SEQ ID No: 2), which encodes inactivated reverse transcriptase. Plasmid pET_his_MLV_D583N_pD was digested with restriction endonuclease XmaJI (recognition sequence C↓CTAGG—positions 1047 and 1218 on SEQ ID No: 1). Gene fragment 171 bp in length was removed and digested plasmid was self-ligated, yielding plasmid pET_his_del_pD (SEQ ID No: 2), which encodes reverse transcriptase gene shorter by 171 nucleotides or 57 amino acids, without shift in protein translation frame.

It was important to have the same reverse transcriptase gene: 1) shorter in length (for easy PCR detection); 2) inactive (it was confirmed experimentally that deletion of 57 amino acids in polymerase domain completely inactivated polymerase activity and mutation D583N inactivated RNase H activity); and 3) without frameshift (any frameshift will result in appearance of STOP codons, which are not compatible with ribosome display format).

Preparation of PCR fragments for in vitro transcription. PCR mixture was prepared on ice: 20 μl-10× Taq buffer with KCl (Fermentas); 20 μl-2 mM of each dNTP (Fermentas); 12 μl-25 mM $MgCl_2$ (Fermentas); 16 μl—DMSO (D8418—Sigma); 4 μl-1 u/μl LC (recombinant) Taq DNA Polymerase (Fermentas); 1 μl—100 μM pro-pIVEX primer (SEQ ID No: 3); 1 μl-100 μM pD-ter primer (SEQ ID No: 4); 122 μl water-mixture divided into two tubes 2×98 μl. To 2×98 μl of PCR master mix were added either 2 μl of pET_his_MLV_pD (diluted to ~1 ng/μl) or 2 μl of pET_his_del_pD (diluted to ~1 ng/μl). The cycling protocol was: initial denaturation step 3 min at 94° C., 30 cycles (45 sec at 94° C., 45 sec at 53° C., and 2 min at 72° C.) and final elongation 5 min at 72° C. Amplification was ~7000 fold from 2 ng of plasmid (7873 bp) target to ~5 μg (50 ng/μl) of amplified product (2702 bp PCR fragment for pET_his_MLV_pD; 2531 bp-PCR fragment for pET_his_del_pD).

Transcription mixture was prepared: 40 □l-5×T7 transcription buffer (1 M HEPES-KOH pH 7.6; 150 mM Mg acetate; 10 mM spermidin; 0.2 M DTT); 56 □l-25 mM of each NTP (Fermentas); 8 □l-20 u/□l T7 RNA polymerase (Fermentas); 4 □l-40 u/□l RiboLock RNase inhibitor (Fermentas); 52 □l nuclease-free water-mixture divided into two tubes 2×80 □l and add 20 □l-50 ng/□l of MLV_pD (pro-pIVEX//pD-ter) or 20 □l-50 ng/□l of del_pD (pro-pIVEX//pD-ter) PCR mixture. Transcription was performed 3 hr at 37° C.

Both transcription mixtures were diluted to 200 μl with ice-cold nuclease-free water and 200 μl of 6 M LiCl solution were added. Mixtures incubated 30 min at +4° C. and centrifuged for 30 min at +4° C. in cooling centrifuge at max speed (25,000 g). Supernatant was discarded and RNA pellet washed with 500 μl of ice-cold 75% ethanol. Tubes again were centrifuged for 5 min at +4° C. in cooling centrifuge at max speed and supernatant was discarded. RNA pellet was dried for 12 min at room temperature and subsequently resuspended in 200 μl of nuclease-free ice-cold water by shaking for 15 min at +4° C. and 1400 rpm. Tubes again were centrifuged for 5 min at +4° C. in cooling centrifuge at max speed in order to separate not dissolved RNA. About 180 μl of supernatant were moved to new tube with 20 μl of 10× DNase I buffer ($Mg^{2+}$) (Fermentas); 1-1 u/μl DNaseI (RNase-free) (Fermentas) and incubated for 20 min at +37° C. in order to degrade DNA. To each tube were added 20 μl of 3 M Sodium acetate pH 5.0 solution and 500 μl of ice-cold 96% ethanol. Finally RNA was precipitated by incubation for 30 min at −20° C. and centrifugation for 30 min at +4° C. in cooling centrifuge at max speed (25,000 g). Supernatant was discarded and RNA pellet washed with 500 μl of ice-cold 75% ethanol. Tubes again were centrifuged for 5 min at +4° C. in cooling centrifuge at max speed and supernatant was discarded. RNA pellet was dried for 12 min at room temperature and subsequently resuspended in 43 μl of nuclease-free ice-cold water by shaking for 15 min at +4° C. and 1400 rpm. RNA solution was aliqouted 4×10 μl and liquid nitrogen frozen. Concentration of mRNA was measured spectrophotometrically and double checked on agarose gel using RiboRuler™ RNA Ladder, High Range (Fermentas)—MLV_pD mRNA ~1.2 μg/μl; del_pD mRNA ~1.2 μg/μl.

Purified mRNA is mixed with ratio 1:50=MLV (active RT):del (inactive RT). MLV_pD mRNA was diluted 25 times to ~48 ng/μl and 1 μl (~48 ng) was mixed with 2 μl~1.2 μg/μl del_pD mRNA (2.4 μg) giving mRNA mixture ~0.8 μg/μl with ratio 1:50. In vitro translation was performed using two translation systems RTS100 *E. coli* HY Kit (03 186 148 001—Roche) and synthetic WakoPURE (295-59503—Wako). Proteins translation sequences are given in SEQ ID No: 6 for MLV_pD and SEQ ID No: 7 for del_pD.

Translation mixture for RTS HY system (25 μl): 6 μl—*E. coli* lysate (Roche); 5 μl—Reaction Mix (Roche); 6 μl—amino acids (Roche); 0.5 μl-100 mM Met (Roche); 0.5 μl-40 u/□l RiboLock RNase inhibitor (Fermentas); 0.4 μl-200 μM assrA oligonucleotide (SEQ ID No: 5); 0.25 μl-1 M DTT; 2.5 μl reconstitution buffer (Roche); 2.5 μl nuclease-free water and 1.5 μl-0.8 μg/μl mRNA mixture 1:50=MLV_p-D:del_pD (~1200 ng). In vitro translation was performed for 20 min at 30° C.

Translation mixture for WakoPURE system (25 μl): 12.5 μl—A solution (Wako); 5 μl—B solution (Wako); 0.5 μl-40 u/□l RiboLock RNase inhibitor (Fermentas); 0.4 μl-200 μM assrA oligonucleotide (SEQ ID No: 6); 0.25 μl-1 M DTT; 5 μl nuclease-free water and 1.5 μl-0.8 μg/μl mRNA mixture 1:50=MLV_pD:del_pD (~1200 ng). In vitro translation was performed for 30 min at 37° C.

Both translations (~25 μl) were stopped by adding 155 μl of ice-cold stopping buffer $WBK_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma)) and centrifuged for 5 min at +4° C. and 25,000 g. Very carefully 160 μl of centrifuged translation mixture was pippeted on the top of 840 μl 35% (w/v) sucrose solution in $WBK_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma); 35% (w/v)—sucrose (84097—Fluka)). In order to purify ternary complexes (TC) of mRNA-ribosome-protein (tRNA) ultracentrifugation was performed using TL-100 Beckman ultracentrifuge; TLA100.2 fixed angle rotor (Beckman); transparent 1 ml ultracentrifugation tubes (343778—Beckman) for 9 min at +4° C. and 100,000 rpm. In order to keep small transparent pellet of TC at the bottom of ultracentrifugation tube intact tubes were handled with care. Initially 750 μl of solution was removed from the very top of the centrifugation tube. Then (very carefully) tube walls were washed with 750 μl of $WBK_{500}$ (50 mM tris-acetate pH 7.5 at 25° C.; 50 mM NaCl; 50 mM Mg-acetate; 500 mM KCl). Finally all solution was removed starting from the very top of the centrifugation tube and pellet was dissolved in 30 μl of ice-cold stopping buffer $WBK_{500}$+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma)).

As it was determined using radioactively labeled mRNA after ultracentrifugation 5%-30% of input mRNA is located in ternary complex pellet. Therefore it was expected to have less than 360 ng (30% from 1200 ng mRNA used in translation reaction) of mRNA in 30 μl of buffer (~12 ng/μl or $9*10^9$ molecules/μl of ternary complex).

Reverse transcription reaction mixture for selection was prepared on ice: 60 μl-5× reaction buffer for Reverse Transcriptase (Fermentas); 7.5 μl-40 u/□l RiboLock RNase inhibitor (Fermentas); 15 μl-20 μM pD__42 oligonucleotide (SEQ ID No: 8); 188 μl nuclease-free water-mixture divided into two tubes 2×135 □l and 0.9 μl of purified (<$8*10^9$ molecules) TC (translation in Roche—RTS HY kit) or 0.9 μl of purified (<$8*10^9$ molecules) TC (translation in Wako—WakoPURE) were added. Each reaction mixture (~135 μl) again was divided into two tubes 45 μl and 90 μl. To the first part—45 μl of RT mixture 5 μl of nuclease-free water were added. This sample is considered to be the negative selection control (without dNTP) and has to prove that there is no DNA contamination in the reaction mixture and cDNA synthesis is strictly linked to reverse transcriptase functional activity coming from MLV RT in ternary complex. To the second part—90 μl of RT mixture 10 μl-10 mM each dNTP Mix (Fermentas) were added and reaction mixture again was divided into two tubes—50 μl for selection control and 50 μl supplemented with 1 μl-200 u/μl of RevertAid H-M-MuLV Reverse Transcriptase (Fermentas) for positive selection control. According to the protocol each reverse transcription reaction mix contains <$2.7*10^9$ molecules of ternary complex in 50 μl volume.

Oil-surfactant mixture for emulsification was prepared by mixing ABIL EM 90 (Goldschmidt) into mineral oil (M5904—Sigma) to final concentration of 4% (v/v) (Ghadessy and Holliger, 2004; US2005064460). Emulsions were prepared at +4° C. in 5 ml cryogenic vials (430492—Corning) by mixing 950 μl of oil-surfactant mixture with 50 μl of RT mixture. Mixing was performed using MS-3000 magnetic stirrer with speed control (Biosan) at ~2100 rpm; Rotilabo®—(3×8 mm) magnetic followers with center ring (1489.2—Roth); water phase was added by 10 μl aliquots every 30 sec, continuing mixing for 2 more minutes (total mixing time—4 min). According to optical microscopy data compartments in our emulsions vary from 0.5 μm to 10 μm in size with average diameter of ~2 μM. Therefore it was expected to have ~$1'10^{10}$ water in oil compartments after the emulsification of 50 μl reverse transcription reaction mixture, which contains less than $2.7*10^9$ molecules of ternary complex (about 1 mRNA and reverse transcriptase molecules per 3-4 compartments).

All six emulsions representing RT reactions with TC, translation in Roche—RTS HY kit (negative selection control, selection control and positive selection control) and with TC, translation in Wako—WakoPURE (negative selection control, selection control and positive selection control) were incubated 1 hr at +42° C.

To recover the reaction mixtures emulsions were moved to 1.5 ml tube, centrifuged for 1-min at room temperature and 25,000 g. Oil phase was removed leaving concentrated (but still intact) emulsion at the bottom of the tube and 250 µl of PB buffer (Qiagen PCR purification kit) were added. Finally emulsions were broken by extraction with 0.9 ml water-saturated ether; 0.9 ml water-saturated ethyl-acetate (in order to remove ABIL EM 90 detergent) and again 0.9 ml water-saturated ether. Water phase was dried for 5 min under vacuum at room temperature. Synthesized cDNA was purified with Qiagen PCR purification kit and eluted in 30 µl of EB buffer (Qiagen PCR purification kit).

Amplification of cDNA was performed by nested PCR. Initial PCR mixture was prepared on ice: 16 µl-10× Taq buffer with KCl (Fermentas); 16 µl-2 mM of each dNTP (Fermentas); 9.6 µl-25 mM $MgCl_2$ (Fermentas); 3.2 µl-1 u/µl LC (recombinant) Taq DNA Polymerase (Fermentas); 0.8 µl-100 µM RD_Nde primer (SEQ ID No: 9); 0.8 µl-100 µM pD__55 primer (SEQ ID No: 10); 74 µl water-mixture was divided into 6 samples×15 µl (6×15 µl) and 30 µl. To 6×15 µl of PCR master mix were added 5 µl of cDNA (1-6 RT samples); to 30 µl of PCR master mix were added 9 µl water and mixture again divided into two tubes 2×19.5 µl for negative PCR control (plus 0.5 µl water) and positive PCR control (plus 0.5 µl-1:1 mixture (~1 ng) of pET_his_MLV_pD and pET_his_del_pD plasmids). The cycling protocol was: initial denaturation step 3 min at 94° C., 25 cycles (45 sec at 94° C., 45 sec at 58° C., and 2 min at 72° C.) and final elongation 5 min at 72° C. Expected length of PCR fragments was 2185 bp for MLV_pD and 2014 bp for del_pD. Amplification was analyzed on 1% agarose gel loading 10 µl of PCR mix per well (FIG. 3).

Nested PCR was performed using two different sets of primers, giving either partial gene amplification (for better resolution of MLV:del cDNA ratio in RT samples) or full gene amplification (to prove possibility of full gene recovery).

Nested PCR mixture for partial gene amplification was prepared on ice: 28 µl-10× Taq buffer with KCl (Fermentas); 28 µl-2 mM of each dNTP (Fermentas); 16.8 µl-25 mM $MgCl_2$ (Fermentas); 5.6 µl-1 u/µl LC (recombinant) Taq DNA Polymerase (Fermentas); 1.4 µl-100 µM M_F primer (SEQ ID No: 11); 1.4 µl-100 µM M__2R primer (SEQ ID No: 12); 185 µl water-mixture divided 2×19 µl and 6×38 µl. To 2×19 µl of PCR master mix was added 1 µl of positive or negative controls of first PCR (primers set RD_Nde//pD__55)-30 PCR cycles amplification; to 6×38 µl of PCR master mix were added 2 µl of first PCR (primers set RD_Nde//pD__55) (1-6 samples)—each sample again was divided into two 2×20 µl for 23 or 30 PCR cycles amplification. The cycling protocol was: initial denaturation step 3 min at 94° C., 23 or 30 cycles (45 sec at 94° C., 45 sec at 57° C., and 1 min at 72° C.) and final elongation 5 min at 72° C. Expected length of PCR fragments was 907 bp for MLV_pD and 736 bp for del_pD. Amplification was analyzed on 1% agarose gel loading 10 µl of PCR mix per well (FIG. 4).

Nested PCR mixture for full gene amplification was prepared on ice: 28 µl-10× Taq buffer with KCl (Fermentas); 28 µl-2 mM of each dNTP (Fermentas); 16.8 µl-25 mM $MgCl_2$ (Fermentas); 5.6 µl-1 u/µl LC (recombinant) Taq DNA Polymerase (Fermentas); 1.4 µl-100 µM M_Esp primer (SEQ ID No: 13); 1.4 µl-100 µM M_Eri primer (SEQ ID No: 14); 185 µl water-mixture divided 2×19 µl and 6×38 W. To 2×19 µl of PCR master mix was added 1 µl of positive or negative controls of first PCR (primers set RD_Nde//pD__55)-30 PCR cycles amplification; to 6×38 µl of PCR master mix were added 2 µl of first PCR (primers set RD_Nde//pD__55) (1-6 samples)—each sample again was divided into 2×20 µl for 23 or 30 PCR cycles amplification. The cycling-protocol was: initial denaturation step 3 min at 94° C., 23 or 30 cycles (45 sec at 94° C., 45 sec at 55° C., and 2 min at 72° C.) and final elongation 5 min at 72° C. Expected length of PCR fragments was 2077 bp for MLV_pD and 1906 bp for del_pD. Amplification was analyzed on 1% agarose gel loading 10 µl of PCR mix per well (FIG. 5).

Results

To demonstrate proof of principle for Compartmentalized Ribosome Display (CRD) method selection was performed using starting 1:50=MLV:del mixture of two mRNA encoding active (MLV) and inactive (del) reverse transcriptases fused to protein D spacer (FIG. 1). In vitro translation was performed using two different translation systems Roche—RTS 100 *E. coli* HY or Wako—WakoPURE in order to understand which translation system is better in our experimental setup. For each translation system three compartmentalized RT reactions were performed: negative selection control without dNTP, which has to prove that there is no DNA contamination in the reaction mixture; selection control, which has to demonstrate the enrichment of genes encoding active (MLV) reverse transcriptase over genes encoding inactivated enzyme (del), because only active enzyme can synthesize cDNA; and positive selection control supplemented with external RevertAid H-commercial reverse transcriptase, which has to serve as positive RT control synthesizing cDNA from both MLV_pD and del_pD mRNA in all compartments, showing real ratio of genes in reaction mixture without selection pressure applied.

Synthesyzed cDNA was amplified by nested PCR. The picture of agarose gel electrophoresis of initial PCR (25 cycles) (FIG. 3) shows weak PCR fragments bands only in case of both positive selection controls (translation systems—Roche and Wako). This is normal, because these samples contain external RT enzyme, which synthesizes cDNA much more efficiently comparing to reactions containing only one in vitro synthesized reverse transcriptase molecule per compartment.

The picture of agarose gel electrophoresis of nested PCR (partial gene amplification) is shown in FIG. 4. Amplification results after 23 and 30 PCR cycles are consistent:

1) there is no amplification (no DNA contamination) in negative selection controls (w/o dNTP);
2) very efficient amplification of delpD cDNA (736 bp DNA fragment) is observed in positive selection controls (external RT enzyme) and no MLV_pD cDNA amplification is visible, because initial ratio of MLV_pD to del_pD mRNA is 1:50;
3) amplification of both cDNA MLV_pD (907 bp DNA fragment) and del_pD (736 bp DNA fragment) are observed in case of selection controls;
4) ratio of MLV_pD:del_pD~1:1 is observed in case of reverse transcriptase synthesized by Roche in vitro translation system, what means ~50 times enrichment of MLV_pD genes over del_pD genes starting from initial 1:50 ratio;
5) ratio of MLV_pD:del_pD~1:3 is observed in case of reverse transcriptase synthesized by Wako in vitro translation system, what means ~16 times enrichment of MLV_pD genes over del_pD genes starting from initial 1:50 ratio.

The picture of agarose gel electrophoresis of nested PCR (full gene amplification) is shown in FIG. 5. Amplification results after 23 and 30 PCR cycles are consistent in between and comparing to results of nested PCR used for partial gene amplification (FIG. 5):

1) there is no amplification (no DNA contamination) in negative selection controls (w/o dNTP);
2) very efficient amplification of del_pD cDNA (1906 bp DNA fragment) is observed in positive selection controls (external RT enzyme) and no MLV_pD cDNA amplification is visible, because initial ratio of MLV_pD to del_pD mRNA is 1:50;
3) amplification of both cDNA MLV_pD (2077 bp DNA fragment) and del_pD 1906 bp DNA fragment) are observed in case of selection controls;
4) it is difficult to determine ratio of MLV_pD:del_pD in case of full gene amplification, because relative difference between 2077 bp (MLV_pD) and 1906 bp (del_pD) DNA fragments is not big enough, but in general ratios are similar to results of nested PCR used for partial gene amplification.

As a result of this example we can conclude that during reverse transcription reaction performed in CRD format we have enriched genes encoding active MLV reverse transcriptase over the genes encoding inactive enzyme by a factor of 50 in case of Roche translation system or by a factor of 16 in case of Wako translation system used to synthesize enzymes in vitro.

Example 2

CRD—Selection for Reverse Transcriptase, which Shows Improved Performance at Higher Temperatures In order to understand, how efficiently Compartmentalized Ribosome Display (CRD) selection works, evolution experiment of Moloney Murine Leukemia Virus reverse transcriptase (M-MuLV RT) was performed. General scheme of experiment is shown in FIG. 6. Initial mutants library of reverse transcriptase was constructed by error-prone PCR using nucleotide analogues dPTP and 8-oxo-dGTP. Whole gene (~2 kb) mutagenesis was performed introducing 2-3 nucleotides or 1-2 amino acids mutations per gene. PCR fragment encoding mutants library of reverse transcriptase (in fusion with protein D) MLV_pD was used to synthesize mRNA. Purified mRNA was used for in vitro translation reaction. Ternary complexes (TC) of mRNA-ribosome-MLV_pD (tRNA) were formed in translation mixture and stabilized by low temperature and high concentration of $Mg^{2+}$ ions. Mixture of TC was purified by ultracentrifugation on sucrose cushions. Precipitated TC was dissolved in ice-cold buffer (50 mM $Mg^{2+}$) and used to prepare reverse transcription reaction mix supplemented with external dNTP set and primer for RT reaction. Ice-cold RT reaction mixture was emulsified giving ~$1*10^{10}$ water in oil compartments ~2 μm in size. Optimal reaction temperature of MLV RT is ~42° C. In order to select for reverse transcriptase variants, which are working better at higher temperatures emulsified RT reaction mixture (less than one TC (mRNA+MLV RT) per compartment) was incubated for 1 hr at 50° C. At this temperature successful synthesis of full length cDNA was performed better in compartments containing more active or thermostable MLV reverse transcriptase variants. Subsequent PCR was used to amplify full length cDNA and enrichment for more active and thermostable reverse transcriptase genes was performed. By PCR amplified genes were moved back to CRD format restoring intact 5' (START fragment—T7 polymerase promoter, SD and his-tag coding sequences) and 3' (END fragment—gs linker, protein D and second gs linker) sequences by ligation-PCR.

Reconstructed PCR fragment, containing enriched library of reverse transcriptase genes, was used for subsequent mRNA transcription and next CRD selection round. Each selection round was performed at higher and higher temperatures of RT reaction: 50° C. ($1^{st}$ round); 52.5° C. ($2^{nd}$ round); 55° C. ($3^{rd}$ round); 57.5° C. ($4^{th}$ round) and 60° C. ($5^{th}$ round).

Amplified library of reverse transcriptase genes (without C terminal pD linker) after $5^{th}$ selection round was cloned into plasmid vector. Individual clones were sequenced and analyzed. Pool of evolved proteins as well as individual mutants were purified via his-tag using affinity chromatography. MLV reverse transcriptase specific activities at 37° C., 50° C. and residual activity at 37° C. after 5 min enzyme incubation at 50° C. were determined.

Methods and Materials

Initial plasmid pET_his_MLV_pD (SEQ ID No: 1 and FIG. 2) was used as a starting material for error-prone PCR. Mutations were introduced using nucleotide analogues dPTP and 8-oxo-dGTP. PCR mixture for error prone PCR was prepared on ice: 10 μl-10× Taq buffer with KCl (Fermentas); 10 μl-2 mM of each dNTP (Fermentas); 6 μl-25 mM $MgCl_2$ (Fermentas); 2 μl-1 u/μl LC (recombinant) Taq DNA Polymerase (Fermentas); 0.5 μl-100 μM M_Esp primer (SEQ ID No: 13); 0.5 μl-100 μl M_Eri primer (SEQ ID No: 14); 1-10 μM dPTP (TriLink BioTechnolgies); 5 μl-100 μM 8-oxo-dGTP (TriLink BioTechnolgies); 3.75 μl-40 ng/μl (totally 150 ng) of pET_his_MLV_pD plasmid; 61.25 μl water. The cycling protocol was: initial denaturation step 3 min at 94° C., 30 cycles (30 sec at 94° C., 30 sec at 55° C., and 2 min at 72° C.) and final elongation 5 min at 72° C. Amplification was 150-300 fold from 150 ng of plasmid (7873 bp) target to ~6-12 μg of amplified product (2077 bp PCR fragment for pET_his_MLV_pD). PCR fragment was purified using Qiagen PCR purification kit, digested with Esp3I (recognition sequence CGTCTC (1/5)) and EcoRI (recognition sequence G↓AATTC) and finally purified from agarose gel using Qiagen Gel extraction kit giving DNA concentration ~50 ng/μl.

Mutagenesis efficiency and library quality was checked by sequencing of individual clones subcloned back into original pET_his_MLV_pD plasmid digested with NcoI and EcoRI. As it was expected mutations were distributed randomly all over the amplified sequence of MLV RT gene (Appendix 1). Among 10 sequenced genes 23 nucleotide mutations (1 transversion, 20 transitions, 2 deletions—labelled red in Appendix 1) were found giving 15 amino acids exchanges, 6 silent mutations, 1 stop codon and 2 frame shifts of coding frame—on average 1-2 amino acids substitutions per gene.

Mutated library was ligated with START (244 bp) and END (398 bp) fragments in order to get PCR fragment suitable for CRD selection (FIG. 7). START fragment (containing T7 polymerase promoter, SD and his-tag coding sequences) was constructed by PCR amplification of initial 983 bp START fragment (target—plasmid pET_his_del_pD (SEQ ID No: 2), primers—pro-pIVEX (SEQ ID No: 3) and M__1R (SEQ ID No: 15)) and subsequent digestion with NcoI (recognition sequence C↓CATGG) giving 244 bp DNA fragment. END fragment (containing gs linker, protein D and second gs linker sequences) was constructed by PCR amplification of initial 1039 bp END fragment (target—plasmid pET_his_del_pD (SEQ ID No: 2), primers—M__3F (SEQ ID No: 16) and pD-ter (SEQ ID No: 4)) and subsequent digestion with EcoRI (recognition sequence G↓AATTC) giving 398 bp DNA fragment.

Ligation reaction (150 μl) was prepared at room temperature: 15 μl-10× ligation buffer for T4 DNA Ligase (Fermentas); 15 μl-1 u/μl T4 DNA ligase (Fermentas); 26 μl-50 ng/μl mutated MLV RT library digested with Esp3I (NcoI compatible end) and EcoRI (~1300 ng or ~5.9*10¹¹ molecules); 9.4 μl-35 ng/μl START fragment digested with NcoI (~329 ng or ~1.2*10¹² molecules); 15.7 μl-35 ng/μl END fragment digested with EcoRI (~548 ng or ~1.2*10¹² molecules); 68.9 μl-water. Ligation was performed overnight at +4° C. Reaction mixture was treated once with phenol and twice with chloroform, precipitated and dissolved in 53 μl of water. Approximate ligation yield ~20% was determined comparing amplification efficiency of ligation mixture and known amount of plasmid pET_his_MLV_pD. Taking into account 20% ligation yield diversity of MLV RT mutants library was defined as ~1.2*10¹¹ molecules (50 μl).

Ligated MLV RT library was amplified by PCR (1 ml—prepared on ice): 100 μl-10× Taq buffer with KCl (Fermentas); 100 μl-2 mM of each dNTP (Fermentas); 60 μl-25 mM MgCl₂ (Fermentas); 80 μl—DMSO (08418—Sigma); 20 μl-1 u/μl LC (recombinant) Taq DNA Polymerase (Fermentas); 5 μl-100 μM pro-pIVEX primer (SEQ ID No: 3); 5 μl-100 μM pD-ter—primer (SEQ ID No: 17); 20 μl—ligated MLV RT library (~5*10¹⁰ molecules); 610 μl—water. The cycling protocol was: initial denaturation step 3 min at 94° C., 15 cycles (30 sec at 94° C., 30 sec at 53° C., and 3 min at 72° C.) and final elongation 5 min at 72° C. Amplification was ~200 fold from ~5*10¹⁰ molecules (corresponds to ~150 ng) of final ligation fragment 2702 bp in size target to ~30 μg (30 ng/μl) of amplified product (2702 bp PCR fragment).

1ˢᵗ Selection Round

Transcription mixture (100 μl) was prepared: 20 μl-5×T7 transcription buffer (1 M HEPES-KOH pH 7.6; 150 mM Mg acetate; 10 mM spermidin; 0.2 M DTT); 28 μl-25 mM of each NTP (Fermentas); 4 μl-20 u/μl T7 RNA polymerase (Fermentas); 2 μl-40 u/μl RiboLock RNase inhibitor (Fermentas); 30 μl-30 ng/μl of mutants library (pro-pIVEX//pD-ter-) PCR mixture (~900 ng or ~3*10¹¹ molecules); 16 μl nuclease-free water. Transcription was performed 3 hr at 37° C. (library diversity ~5*10¹⁰ molecules).

Transcription mixture was diluted to 200 μl with ice-cold nuclease-free water and 200 μl of 6 M LiCl solution were added. Mixture incubated 30 min at +4° C. and centrifuged for 30 min at +4° C. in cooling centrifuge at max speed (25,000 g). Supernatant was discarded and RNA pellet washed with 500 μl of ice-cold 75% ethanol. Tube again was centrifuged for 5 min at +4° C. in cooling centrifuge at max speed and supernatant was discarded. RNA pellet was dried for 12 min at room temperature and subsequently resuspended in 200 μl of nuclease-free ice-cold water by shaking for 15 min at +4° C. and 1400 rpm. Tube again was centrifuged for 5 min at +4° C. in cooling centrifuge at max speed in order to separate not dissolved RNA. About 180 μl of supernatant were moved to new tube with 20 μl of 10× DNase I buffer (Mg²⁺) (Fermentas); 1-1 u/μl DNaseI (RNase-free) (Fermentas) and incubated for 30 min at +37° C. in order to degrade DNA. To reaction mixture were added 20 μl of 3 M Sodium acetate pH 5.0 solution and 500 μl of ice-cold 96% ethanol. Finally RNA was precipitated by incubation for 30 min at −20° C. and centrifugation for 30 min at +4° C. in cooling centrifuge at max speed (25,000 g). Supernatant was discarded and RNA pellet washed with 500 μl of ice-cold 75% ethanol. Tube again was centrifuged for 5 min at +4° C. in cooling centrifuge at max speed and supernatant was discarded. RNA pellet was dried for 12 min at room temperature and subsequently resuspended in 33 μl of nuclease-free ice-cold water by shaking for 10 min at +4° C. and 1400 rpm. RNA solution was aliqouted 3×10 μl and liquid nitrogen frozen. Concentration of mRNA was measured spectrophotometrically and double checked on agarose gel using RiboRuler™ RNA Ladder, High Range (Fermentas)-MLV RT library mRNA ~2.1 μg/μl.

In vitro translation was performed using RTS 100 E. coli HY (03 186 148 001—Roche) translation system (25 μl): 6 μl—E. coli lysate (Roche); 5 μl—Reaction Mix (Roche); 6 μl—amino acids (Roche); 0.5 μl-100 mM Met (Roche); 0.5 μl-40 u/1:11 RiboLock RNase inhibitor (Fermentas); 0.4 μl-200 μM assrA oligonucleotide (SEQ ID No: 5); 0.25 μl-1 M DTT; 3 μl reconstitution buffer (Roche); 2.5 μl nuclease-free water and 0.6 μl-2.1 μg/μl mRNA (~1200 ng). Reaction mixture was incubated for 20 min at 30° C. Translation was stopped adding 155 μl of ice-cold stopping buffer WBK₅₀₀+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma)) and centrifuged for 5 min at +4° C. and 25,000 g. Very carefully 160 μl of centrifuged translation mixture was pippeted on the top of 840 μl 35% (w/v) sucrose solution in WBK₅₀₀+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma); 35% (w/v)—sucrose (84097—Fluke)). In order to purify ternary complexes (TC) of mRNA-ribosome-MLV (tRNA) ultracentrifugation was performed using TL-100 Beckman ultracentrifuge; TLA100.2 fixed angle rotor (Beckman); transparent 1 ml ultracentrifugation tubes (343778—Beckman) for 9 min at +4° C. and 100,000 rpm. In order to keep small transparent pellet of TC at the bottom of ultracentrifugation tube intact tubes were handled with care. Initially 750 μl of solution was removed from the very top of the centrifugation tube. Than (very carefully) tube walls were washed with 750 μl of WBK₅₀₀ (50 mM tris-acetate pH 7.5 at 25° C.; 50 mM NaCl; 50 mM Mg-acetate; 500 mM KCl). Finally all solution was removed starting from the very top of the centrifugation tube and pellet was dissolved in 30 μl of ice-cold stopping buffer WBK₅₀₀+DTT+triton (50 mM tris-acetate pH 7.5 at 25° C.; 50 mM NaCl; 50 mM Mg-acetate; 500 mM KCl; 10 mM DTT; 0.1% (v/v)—triton x-100 (T8787—Sigma)).

As it was determined experimentally, using radioactively labeled mRNA, ultracentrifugation yields 5%-30% of input mRNA in ternary complex pellet. Therefore it was expected to have less than 360 ng (30% from 1200 ng mRNA used in translation reaction) of mRNA in 30 μl of buffer (~12 ng/μl or 9*10⁹ molecules/μl of ternary complex).

Reverse transcription reaction mixture for selection was prepared on ice: 60 μl-5× reaction buffer for Reverse Transcriptase (Fermentas); 7.5 μl-40 u/μl RiboLock RNase inhibitor (Fermentas); 15 μl-20 μM pD_42 oligonucleotide (SEQ ID No: 8); 186 μl nuclease-free water and 1.8 μl of purified (<1.8*10¹⁰ molecules) TC (translation in Roche—RTS HY kit). Reaction mixture was divided into two tubes 45 μl and 225 μl. To first part—45 μl of RT mixture were added 5 μl of nuclease-free water. This sample was considered to be negative selection control (without dNTP) and has to prove that there is no DNA contamination in the reaction mixture and cDNA synthesis is strictly linked to reverse transcriptase functional activity coming from MLV RT in ternary complex. To second part—225 μl of RT mixture were added 25 μl-10 mM each dNTP Mix (Fermentas) and reaction mixture again was divided into two tubes −200 μl (4×50 μl) for selection control (<1.2*10¹⁰ molecules of TC totally) and 50 μl supplemented with 1 μl-200 u/μl of RevertAid H-M-MuLV Reverse Transcriptase (Fermentas) for positive selection control. According to protocol each reverse transcription reaction mix contains <3*10⁹ molecules of ternary complex in 50 μl volume.

Oil-surfactant mixture for emulsification was prepared by mixing ABIL EM 90 (Goldschmidt) into mineral oil (M5904—Sigma) to final concentration of 4% (v/v) (Ghadessy and Holliger, 2004; US2005064460). Emulsions were prepared at +4° C. in 5 ml cryogenic vials (430492—Corning) by mixing 950 µl of oil-surfactant mixture with 50 µl of RT mixture. Mixing was performed using MS-3000 magnetic stirrer with speed control (Biosan) at ~2100 rpm; Rotilabo®—(3×8 mm) magnetic followers with centre ring (1489.2—Roth); water phase was added by 10 µl aliquots every 30 sec, continuing mixing for 2 more minutes (total mixing time—4 min). According to optical microscopy data compartments in our emulsions vary from 0.5 µm to 10 µm in size with average diameter of ~2 µm. Therefore it was expected to have ~1*10$^{10}$ water in oil compartments after the emulsification of 50 µl reverse transcription reaction mixture, which contains less than 3*10$^9$ molecules of ternary complex (about 1 mRNA and reverse transcriptase molecules per 3-4 compartments).

All emulsions were incubated 1 hr at +50° C. in order to select for reverse transcriptase variants, which work better at higher temperatures. To recover the reaction mixtures emulsions were moved to 1.5 ml tube, centrifuged for 10 min at room temperature and 25,000 g. Oil phase was removed leaving concentrated (but still intact) emulsion at the bottom of the tube. Emulsions were broken by extraction with 0.9 ml water-saturated ether, 0.9 ml water-saturated ethyl-acetate (in order to remove ABIL EM 90 detergent) and again 0.9 ml water-saturated ether. Water phase was dried for 5 min under vacuum at room temperature and 250 µl of PB buffer (Qiagen PCR purification kit) were added. Four selection samples were merged into two tubes. Synthesized cDNA was further purified with Qiagen PCR purification kit and eluted in 30 µl of EB buffer (Qiagen PCR purification kit) in case of negative and positive selection controls and 2×30 µl in case of selection control.

Amplification of cDNA was performed by nested PCR. First of all small PCR amplification was performed in order to check negative and positive selection controls and determine minimal number of PCR cycles required for efficient amplification of cDNA in selection samples. PCR mixture (200 µl) was prepared on ice: 20 µl-10× Taq buffer with KCl (Fermentas); 20 µl-2 mM of each dNTP (Fermentas); 12 µl-25 mM MgCl$_2$ (Fermentas); 2.5 µl-1 u/µl LC (recombinant) Taq DNA Polymerase (Fermentas); 1-2.5 u/µl Pfu DNA Polymerase (Fermentas); 1-100 µM RD_Nde primer (SEQ ID No: 9); 1 µl-100 µM pD_55 primer (SEQ ID No: 10); 50 µl—purified cDNA of selection controls; 92 µl water. The cycling protocol for 2185 bp PCR fragment was: initial denaturation step 3 min at 94° C., 25 cycles (45 sec at 94° C., 45 sec at 58° C., and 2 min at 72° C.) and final elongation 5 min at 72° C.

Nested PCR mixture (500 µl) for full gene amplification was prepared on ice: 50 µl-10× Taq buffer with KCl (Fermentas); 50 µl-2 mM of each dNTP (Fermentas); 30 µl-25 mM MgCl$_2$ (Fermentas); 6.25 µl-1 u/µl LC (recombinant) Taq DNA Polymerase (Fermentas); 2.5 µl-2.5 u/µl Pfu DNA Polymerase (Fermentas); 2.5 µl-100 µM M_Esp primer (SEQ ID No: 13); 2.5 µl-100 µM M_Eri primer (SEQ ID No: 14); 50 µl of first PCR (primers-set RD_Nde//pD_55); 306 µl water. The cycling protocol for 2077 bp PCR fragment was: initial denaturation step 3 min at 94° C., 22 cycles (45 sec at 94° C., 45 sec at 55° C., and 2 min at 72° C.) and final elongation 5 min at 72° C.

Final PCR fragment of selection sample was agarose-gel purified using Qiagen gel extraction kit (elution in 60 µl~50 ng/µl). Purified PCR fragment was digested with EcoRI and Esp3I for 1 hr at 37° C. and again agarose-gel purified (elution in 30 µl~50 ng/µl).

Recovered MLV reverse transcriptase library after 1$^{st}$ selection round was ligated with START and END fragments (construction described earlier in this example) in order to get PCR fragment (FIG. 7) suitable for 2$^{nd}$ round of CRD selection (FIG. 6). Ligation reaction (40 µl) was prepared at room temperature: 4 µl-10× ligation buffer for T4 DNA Ligase (Fermentas); 2 µl-1 u/µl T4 DNA ligase (Fermentas); 4 µl-50 ng/µl selected library digested with Esp3I and EcoRI (~200 ng or ~0.9*10$^{11}$ molecules); 1.1 µl-35 ng/µl START fragment digested with NcoI (~35 ng or ~1.5*10$^{11}$ molecules); 1.76 µl-35 ng/µl END fragment digested with EcoRI (~61 ng or ~1.5*10$^{11}$ molecules); 27.2 µl-water. Ligation was performed 1 hr at room temperature.

Ligated MLV RT library was amplified by PCR (300 µl—prepared on ice): 30 µl-10× Taq buffer with KCl (Fermentas); 30 µl-2 mM of each dNTP (Fermentas); 18 µl-25 mM MgCl$_2$ (Fermentas); 24 µl—DMSO (D8418—Sigma); 3.7 µl-1 u/µl LC (recombinant) Taq DNA Polymerase (Fermentas); 1.5 µl-2.5 u/µl Pfu DNA Polymerase (Fermentas); 1.5 µl-100 µM pro-pIVEX primer (SEQ ID No: 3); 1.5 µl-100 µM pD-ter-primer (SEQ ID No: 17); 25.5 µl—ligated MLV RT library (<0.6*10$^{10}$ molecules); 164.3 µl-water. The cycling protocol for 2702 bp PCR fragment was: initial denaturation step 3 min at 94° C., 15 cycles (45 sec at 94° C., 45 sec at 53° C., and 3 min at 72° C.) and final elongation 5 min at 72° C. PCR fragment was agarose-gel purified using Qiagen gel exraction kit (elution in 30 µl~100 ng/µl).

2$^{nd}$ Selection Round

Second selection round was performed following general setup of 1° selection round of experimental scheme with minor modifications in PCR cycles, emulsified RT reaction temperature and few more details.

All modifications are given below:
transcription—10 µl-100 ng/µl (~1000 ng) of agarose-gel purified PCR fragment were taken; final concentration of mRNA used in 2$^{nd}$ selection round was 1.5 µg/µl;
translation—0.8 µl (~1.2 µg) of mRNA were taken;
emulsified RT reaction was performed 1 hr at 52.5° C.;
1$^{st}$ PCR (RD_Nde//pD_55)—24 cycles were performed;
2$^{nd}$ (nested) PCR (M_Esp//M_Eri)—23 cycles were performed;
final concentration of digested PCR fragment—80 ng/µl;
ligation—200 ng (~0.9*10$^{11}$ molecules) of MLV RT library were taken;
PCR (on ligation mix)—<0.6*10$^{10}$ molecules of selected library were taken and 15 PCR cycles were performed; concentration of final agarose-gel purified PCR fragment was 200 ng/µl.

3$^{rd}$ Selection Round

Third selection round was performed following general setup of 1$^{st}$ selection round of experimental scheme with minor modifications in PCR cycles, emulsified RT reaction temperature and few more details.

All modifications are given below:
transcription—5 µl-200 ng/µl (~1000 ng) of agarose-gel purified PCR fragment were taken; final concentration of mRNA used in 3$^{rd}$ selection round was 1.5 µg/µl;
translation—0.8 µl-1.5 µg/µl (~1.2 µg) of mRNA were taken;
emulsified RT reaction was performed 1 hr at 55° C.;
1$^{st}$ PCR (RD_Nde//pD_55)—25 cycles were performed;
2$^{nd}$ (nested) PCR (M_Esp//M_Eri)—22 cycles were performed;
final concentration of digested PCR fragment—70 ng/µl;

ligation—200 ng (~0.9*10$^{11}$ molecules) of MLV RT library were taken;

PCR (on ligation mix)—<0.6*10$^{10}$ molecules of selected library were taken and 15 PCR cycles were performed; concentration of final agarose-gel purified PCR fragment was 100 ng/μl.

4$^{th}$ Selection Round

Fourth selection round was performed following general setup of 1$^{st}$ selection round of experimental scheme with minor modifications in PCR cycles, emulsified RT reaction temperature and few more details.

All modifications are given bellow:

transcription—10 μl-100 ng/μl (~1000 ng) of agarose-gel purified PCR fragment were taken; final concentration of mRNA used in 4$^{th}$ selection round was 1.8 μg/μl;

translation—0.67 μl-1.8 μg/μl (~1.2 μg) of mRNA were taken;

emulsified RT reaction was performed 1 hr at 57.5° C.;

1$^{st}$ PCR (RD_Nde//pD_55)—25 cycles were performed;

2$^{nd}$ (nested) PCR (M_Esp//M_Eri)—24 cycles were performed;

final concentration of digested PCR fragment—50 ng/μl;

ligation—200 ng (~0.9*10$^{11}$ molecules) of MLV RT library were taken;

PCR (on ligation mix)—<0.6*10$^{10}$ molecules of selected library were taken and 15 PCR cycles were performed; concentration of final agarose-gel purified PCR fragment was 100 ng/μl.

5$^{th}$ Selection Round

Fifth selection round was performed following general setup of 1$^{st}$ selection round of experimental scheme with some modifications in PCR cycles, emulsified RT reaction temperature and final stage of analysis.

All modifications are given bellow:

transcription—10 μl-100 ng/μl (~1000 ng) of agarose-gel purified PCR fragment were taken; final concentration of mRNA used in 5$^{th}$ selection round was 1.1 μg/μl;

translation—1.1 μl-1.1 μg/μl (~1.2 μg) of mRNA were taken;

emulsified RT reaction was performed 1 hr at 60° C.;

1$^{st}$ PCR (RD_Nde//pD_55)—25 cycles were performed;

2$^{nd}$ (nested) PCR (M_Esp//M_Eri)—33 cycles were performed;

Nested PCR mixture (500 μl) for full gene amplification was prepared on ice: 50 μl-10×Taq buffer with KCl (Fermentas); 50 μl-2 mM of each dNTP (Fermentas); 30 μl-25 mM MgCl$_2$ (Fermentas); 6.25 μl-1 u/μl LC (recombinant) Taq DNA Polymerase (Fermentas); 2.5 μl-2.5 u/μl Pfu DNA Polymerase (Fermentas); 2.5 μl-100 μM M_Esp primer (SEQ ID No: 13); 2.5 μl-100 μM M_Hind3+ primer (SEQ ID No: 18); 50 μl of first PCR (primers set RD_Nde//pD_55); 306 μl water. The cycling protocol for 2077 bp PCR fragment was: initial denaturation step 3 min at 94° C., 22 cycles (45 sec at 94° C., 45 sec at 55° C., and 3 min at 72° C.) and final elongation 5 min at 72° C.

Final PCR fragment of selection sample was agarose-gel purified using Qiagen gel extraction kit (elution in 60 μl-60 ng/μl). Purified PCR fragment was digested with HindIII and Esp3I for 1 hr at 37° C. and again agarose-gel purified (elution in 40 μl-50 ng/μl).

Recovered MLV reverse transcriptase library after 5$^{th}$ selection round was ligated into plasmid vector prepared from pET_his_MLV_pD (SEQ ID No: 1 and FIG. 2) digested with NcoI and HindIII, giving new 7474 bp plasmid pET_his_MLV (SEQ ID No: 19) encoding MLV RT with N-terminal his-tag and no pD fusion on C-terminus for fast protein purification using affinity chromatography.

Ligated MLV RT library after 5$^{th}$ selection round was electroporated into T7 expression strain ER2566. Individual clones were sequenced and analyzed. Pool of evolved proteins as well as individual mutants and primary wt M-MuLV reverse transcriptase in the same construction were grown in 200 ml of LB to A590 ~0.7 and purified via his-tag by affinity chromatography using 2 ml of Qiagen-Ni-NTA Superflow resin (all purification was performed under native conditions according to suppliers recommendations). Elution was performed in 1 ml of EB (50 mM—NaH$_2$PO$_4$, 300 mM—NaCl, 250 mM—imidazol, pH 8.0, 10 mM—β-mercaptoethanol and 0.1% of triton X-100). All proteins were dialyzed against 50 times excess of storage buffer (50 mM Tris-HCl (pH 8.3 at 25° C.), 0.1 M NaCl, 1 mM EDTA, 5 mM DTT, 0.1% (v/v). Triton X-100 and 50% (v/v) glycerol). Protein purity was checked on SDS-PAGE (usually ~40-80% of target protein). Protein concentration was determined using Bredford method based Bio-Rad protein assay (500-0006).

MLV reverse transcriptase specific activities were measured at 37° C., 50° C. (enzyme diluted in special dilution buffer: 30 mM Tris-HCl pH 8.3 at 25° C., 10 mM DTT, 0.5 mg/ml BSA) and rest of activity at 37° C. after 5 min enzyme incubation at 50° C. (enzyme diluted and its stability measured in 1×RT reaction buffer: 50 mM Tris-HCl pH 8.3 at 25° C., 4 mM MgCl$_2$, 10 mM DU, 50 mM KCl). Enzyme activity in all cases was assayed in the following final mixture: 50 mM Tris-HCl (pH 8.3 at 25° C.), 6 mM MgCl$_2$, 10 mM DTT, 40 mM KCl, 0.5 mM dTTP, 0.4 MBq/ml [3H]-dTTP, 0.4 mM polyA.oligo(dT)$_{12-18}$. Activity units were determined measuring incorporation of dTMP into a polynucleotide fraction (adsorbed on DE-81) in 10 min at particular reaction temperature and comparing to known amounts of commercial enzyme.

Results

During analysis of selection data we have accumulated 104 sequences expressing full length M-MuLV reverse transcriptase. The total CLUSTALW alignment of all proteins (Appendix 2) is compiled without N terminal His tag in order to have the same numeration of amino acids as is usually used in literature. Wild type sequence denoted as MLV is always given as the first sequence. Mutations are marked using white font color in black background (Appendix 2). Amino acids positions, mutations of which somehow improve M-MuLV reverse transcriptase properties and are described in different patent applications are marked in the alignment as columns of amino acids (white font) highlighted in grey. Mutations originating from our selection and located in grey columns serve as proof that our selection procedure precisely targeted the beneficial hot spot or even exact amino acid mutations described elsewhere. Out of 104 sequenced clones we found 98 unique sequences and 1 wt (L5_87) sequence. Five sequences are repeated twice (L5_21 and L5_111; L5_43 and L5_112; L5_49 and L5_63; L5_64 and L5_93; L5_85 and L5_96). In total we had randomly expressed 55 proteins. Out of 55 expressed proteins 40 enzymatically active mutant variants (including control wt) of M-MuLV reverse transcriptase were successfully purified to 40-80% homogeneity according to SDS-PAGE. Total protein concentration in purified RT samples was in range of 0.6-5.5 mg/ml. Mutant RT variants were tested for reverse transcriptase activity at 37° C., 50° C. and residual activity at 37° C. after 5 min incubation at 50° C. (FIG. 8). Reverse transcriptase activity at 37° C. is normalized to be 100% and is omitted in FIG. 8. Thus only two types of columns (percents of RT activity at 50° C. and residual RT activity at 37° C. after 5 min incubation at 50° C.) are shown. As a control wt M-MuLV reverse transcriptase used for mutants library construction is presented. This primary enzyme was expressed in the same vector and purified in the same way as mutant variants of RT. An average value of wt enzyme RT activity at 50° C. is about 45% comparing to activity at 37° C. Almost all tested proteins, with few exceptions, have higher than 45% activity at 50° C. An average value of RT activity at 50° C. for all tested mutants is about ~92% and is more than 2 times higher comparing to wt enzyme (45%). Some mutants are 100% or even more active at 50° C. as they are at 37° C.: 20, 23, L5_16, L5_24, L5_30, L5_35, L5_37, L5_43, L5_46, L5_47, L5_49, L5_52, L5_55, L5_64, L5_65, L5_68, L5_72. The best mutants found have RT activity at 50° C. about 140% and more (3 times higher than 45% of wt): 20 (165%), L5_37 (162%), L5_43 (156%), L5_46 (135%), L5_47 (179%), L5_52 (137%), L5_64 (142%) and L5_68 (153%).

Even though majority of mutants have very high RT activities at 50° C., they are not as thermostable. Residual RT activity at 37° C. after 5 min incubation at 50° C. of wt control is ~11%. The same average residual activity of selected enzymes is also similar ~12%. Although some tested RT variants are substantially more thermostable and have residual activity 2-3 times higher than wt enzyme (11%): L5_8 (25%), L5_43 (32%), L5_46 (27%), L5_64 (28%), L5_65 (25%), L5_68 (31%).

Specific activity (u/mg of protein) for partially purified wt enzyme is ~200,000 u/mg (FIG. 9). Selected RT variants were expressed and purified in very diverse manner and an average specific activity (~155,000 u/mg) is slightly lower as for wt control (FIG. 9). In some cases specific activity is decreased, in some—increased (20—274,000 u/mg; L5_11—273,000 u/mg; L5_28—230,000 u/mg; L5_30—224,000 u/mg; L5_35—316,000 u/mg; L5_43—328,000 u/mg; L5_46—304,000 u/mg; L5_52—310,000 u/mg; L5_64—256,000 u/mg; L5_65—247,000 u/mg).

It is obvious that our selection system works well. Using increased temperature of RT reaction as a selection pressure factor, we have managed to evolve faster (specific RT activity at 50° C. is higher) and more thermostable (residual RT activity at 37° C. after 5 min preincubation at 50° C.) reverse transcriptases.

The source of valuable information is an alignment of selected protein sequences (Appendix 2). Sequences of analyzed proteins, whose activity at 50° C. was substantially better as compared to primary wt M-MuLV (70% and more comparing to 45% of wt activity) are highlighted in grey (Appendix 2). Number of mutagenized amino acids varied in range of 0 (wt or L5_87) to 12 (L5_9). List of mutations found in all selected RT variants is given in Appendix 3. Proteins are sorted by decreasing number of mutations. Most mutants (53 out of 104) had 4-6 mutations per sequence. It is obvious that reverse transcriptase sequence has some hot spots, which are very important and beneficial for the RT reaction in general and for the thermostability of enzyme. Those hot spots can be easily identified in multiple sequence alignment (Appendix 2) as conglomeration of mutations at particular position. Especially important are mutations found in better performing variants of M-MuLV reverse transcriptase (sequences are highlighted in grey—Appendix 2). Summarized information about the most frequent mutations (in decreasing order) is given in Appendix 4. As in previous appendix mutant proteins with substantially higher activity at 50° C. are highlighted in grey. If same mutation repeats for many times and tested reverse transcriptases with this mutation are better performing at 50° C., that means this mutation is somehow beneficial for reverse transcription reaction.

According to the frequency with which mutations are found they can be divided into five classes: 21-31 repeats; 14-18 repeats; 4-7 repeats; 2-3 repeats and 1 repeat. The first group of the most frequent mutations comprises four amino acids D524 (31 repeats); D200 (30 repeats); D653 (23 repeats) and D583 (21 repeats). Two amino acids (D524 and D583) are known to complex magnesium ions in active centre of ribonuclease H domain. Mutants D524G, D583N and E562Q are used to turn off RNase H activity of M-MuLV reverse transcriptase (Gerard et al., 2002), what improves synthesis of cDNA. Results of our selection are strikingly similar. Mutation of aspartate 524 is found in 31 sequences out of 98. Moreover, D524N substitution is found once, D524A—10 times and finally D524G—20 times. Thus our selection not only precisely targeted important amino acids, but also the same amino acid substitutions, which are known to be the best. Exactly the same situation is with mutation of aspartate 583, which is repeated in 21 selected proteins out of 104. Substitution D583E is found once, D583A—3 times, D583G—7 times and finally D583N—10 times. Again, same amino acid and same substitution (D583N), which is known to be the best is selected most frequently. Commercial enzyme SUPERSCRIPT II from Invitrogen has three mutations: D524G, D583N and E562Q (WO2004024749). An interesting thing is that mutation of the third amino acid substitution E562 in our selection is found only once (E562K in L5_71). This result suggests that most likely glutamate 562 is not as important as aspartates 524 and 583, or for some reasons exchange of this amino acid can cause some side effects and is not beneficial for RT reactions performed at increased temperatures (>50° C.).

Further analysis of selected proteins sequences allowed to identify many more hot amino acids positions, mutations of which are described in other patent applications for improved M-MuLV reverse transcriptase: H204R—7 repeats (U.S. Pat. No. 7,078,208); H638R—4 repeats (US20050232934A1); T197A—2 repeats (U.S. Pat. No. 7,056,716); M289V(L), T306(M)—2 repeats (U.S. Pat. No. 7,078,208); E302K, N454K—2 repeats (WO07022045A2); E69G, L435F—1 sequence (WO07022045A2); Y64C, Q190R, V223M, F309S—1 sequence (U.S. Pat. No. 7,056,716); E562K—1 sequence (U.S. Pat. No. 7,078,208). There are also two selected sequences of reverse transcriptases which have combination of three amino acids substitutions described in literature (30—D200N, T306M, 0524N, D583G; L5_28—T306k F309S, D524A, H594R, F625S).

In addition to known mutations we have identified many more amino acids positions which are mutated quite often: D200N(A, G)—30 repeats; D653N(G, A, H, V)—23 repeats; L603W(M)—18 repeats; T330P—15 repeats; L139P—14 repeats; Q221R—6 repeats; T287A—6 repeats; 149V(T)—5 repeats; N479D—5 repeats; H594R(Q)—5 repeats; F625S (L)—5 repeats; P65S—4 repeats; H126S(R)—4 repeats; L333Q(P)—4 repeats; A502V—4 repeats; E607K(G, A)—4 repeats; K658R(Q)—4 repeats; H8P(R)-3 repeats; P130S—3 repeats; E233K—3 repeats; Q237R—3 repeats; N249D—3 repeats; A283D(T)—3 repeats; A307V—3 repeats; Y344H—3 repeats; P407S(L)—3 repeats; M428L—3 repeats; Q430R—3 repeats; D449G(A)—3 repeats; A644V (T)—3 repeats; N649S—3 repeats; L671P—3 repeats; E673G(K)—3 repeats; N678I—3 repeats (Appendix 4).

Best performing variants of RT usually have mutations of amino acids, which are modified most frequently:
20 (50° C.-123%)—D200N (30 repeats), L603W (18 repeats) and slightly modified C terminus—N678I, S679P, R680A;
L5_35 (50° C.-125%)—D200N (30 repeats), T330P (15 repeats), N479D (5 repeats);

L5_37 (50° C.-162%)—H123S (4 repeats), L149F (1 sequence), D200N (30 repeats), N454K (2 repeats), D583N (21 repeats);

L5_43 (50° C.-160%)—D200N (30 repeats), Q237R (3 repeats), T330P (15 repeats), D524G (31 repeats), F625S (5 repeats), D653N (23 repeats);

L5_46 (50° C.-135%)—D200N (30 repeats), T330P (15 repeats), D583N (21 repeats), T644T (3 repeats);

L5_47 (50° C.-179%)—N107S (1 repeat), H126R (4 repeats), T128A (1 repeat), I179V (2 repeats), D200N (30 repeats), H642Y (2 repeats), D653N (23 repeats);

L5_52 (50° C.-137%)—D200N (30 repeats), T330P (15 repeats), Q374R (2 repeats), (D583N (21 repeats);

L5_64 (50° C.-142%)—D200N (30 repeats), D216G (2 repeats), D524G (31 repeats), E545G (2 repeats);

L5_65 (50° C.-127%)—D200N (30 repeats), Q238H (1 repeat), L570I (1 repeat), L603W (18 repeats);

L5_68 (50° C.-153%)—M39V (2 repeats), I49V (2 repeats), Q91R (2 repeats), H204V (7 repeats), T287A (6 repeats), N454K (2 repeats), F625L (5 repeats), D653H (23 repeats).

The combined data set of measured RT activities and sequence alignment analysis of mutant proteins allowed us to determine many beneficial mutations (and combinations thereof) in the sequence of M-MuLV reverse transcriptase sequence.

Example 3

Analysis of Moloney Murine Leukemia Virus Reverse Transcriptase Mutants

In vitro evolution experiment described in 2$^{nd}$ example was very efficient. Gradually increased temperature of reverse transcription reaction was used as a selection pressure and generated a lot of different mutant variants of M-MuLV RT. Most of them were able to perform better at elevated temperatures comparing to primary enzyme. Sequence analysis of evolved reverse transcriptases indicates hot spots and most important amino acids positions (replacements), responsible for complex improvement of enzyme properties. In order to elucidate individual impact of different mutations single and multiple mutants of M-MuLV RT were constructed, partially purified and analyzed. Starting point for mutants construction was 7474 bp plasmid pET_his_MLV (SEQ ID No: 19) encoding M-MuLV RT with N-terminal his-tag for fast protein purification using affinity chromatography. M-MuLV reverse transcriptase specific activity at 37° C., relative activity at 50° C. and relative residual activity at 37° C. after 5 min enzyme incubation at 50° C. were determined. In some cases RNase H activity was checked and cDNA synthesis reaction at different temperatures on 1 kb or 4.5 kb RNA was performed.

Methods and Materials

Initial plasmid pET_his_MLV (SEQ ID No: 19) was used as a starting material for mutagenic PCR. Mutations were introduced using mutagenic primers. Individual clones were sequenced and analyzed. M-MuLV RT mutants were expressed in T7 expression strain ER2566. Individual proteins and primary wt M-MuLV reverse transcriptase in the same construction were grown in 200 ml of LB to A590 ~0.7 and purified via his-tag by affinity chromatography using 2 ml of Qiagen-Ni-NTA Superflow resin (all purification was performed under native conditions according to suppliers recommendations). Elution was performed in 1 ml of EB (50 mM—NaH$_2$PO$_4$, 300 mM—NaCl, 250 mM—imidazol, pH 8.0, 10 mM—β-mercaptoethanol and 0.1% of triton X-100). All proteins were dialyzed against 50 times excess of storage buffer (50 mM Tris-HCl (pH 8.3 at 25° C.), 0.1 M NaCl, 1 mM EDTA, 5 mM DTT, 0.1% (v/v) Triton X-100 and 50% (v/v) glycerol). Protein purity was checked on SDS-PAGE (usually ~40-80% of target protein). Protein concentration was determined using Bradford reagent (Fermentas #R1271).

MLV reverse transcriptase activities were measured at 37° C., 50° C. (enzyme diluted in special dilution buffer: 30 mM Tris-HCl pH 8.3 at 25° C., 10 mM DTT, 0.5 mg/ml BSA) and rest of activity at 37° C. after 5 min enzyme incubation at 50° C. (enzyme diluted and its stability measured in 1×RT reaction buffer: 50 mM Tris-HCl pH 8.3 at 25° C., 4 mM MgCl$_2$, 10 mM DTT, 50 mM KCl). Enzyme activity in all cases was assayed in the following final mixture: 50 mM Tris-HCl (pH 8.3 at 25° C.), 6 mM MgCl$_2$, 10 mM DTT, 40 mM KCl, 0.5 mM dTTP, 0.4 MBq/ml [31-1]-dTTP, 0.4 mM polyA.oligo (dT)$_{12-18}$. Activity units were determined measuring incorporation of dTMP into a polynucleotide fraction (adsorbed on DE-81) in 10 min at particular reaction temperature and comparing to known amounts of commercial enzyme. RNase H activity of M-MuLV reverse transcriptase variants was measured according to U.S. Pat. No. 5,405,776. RNase H activity of purified enzymes was assayed in reaction mixtures (50 µl) containing 50 mM Tris-HCl pH 8.3, 2 mM MnCl$_2$, 1 mM DTT and [3H](A)n*(dT)n (5 µM [3H](A)n, 35 cpm/µmol; 20 µM (dT)n). Reactions were incubated at 37° C. for 10 min and were stopped by adding 10 µl of tRNA (1 mg/ml) and 20 µl of cold 50% TCA. After 10 minutes on ice, the mixture was centrifuged for 10 minutes in an Eppendorf centrifuge (at 25000 g). Forty µl of the supernatant was counted in a LSC-universal cocktail (Roth—Rotiszint eco plus). One unit of RNase H activity is the amount of enzyme required to solubilize one mole of [3H](A)$_n$ in [3H](A)$_n$*(dT)$_n$ in 10 min at 37° C.

"RevertAid™ First Strand cDNA Synthesis Kit" (#K1622-Fermentas) and its control 1.1 kb RNA with a 3'-poly(A) tail in combination with oligo(dT)$_{18}$ primer was used to check purified reverse transcriptases for their ability to synthesize cDNA at different temperatures. Alternatively 4.5 kb RNA (synthesized from Eco311 linearized pTZ19R plasmid, which additionally contains piece of phage lambda DNA 5505-8469 bp) was used to test reverse transcription reaction. cDNA was synthesized 1 hr in 20 µl reaction volume using kit's components 1 µg of synthetic RNA, following provided protocol with only some minor modifications (without 5 min preincubation at 37° C.). Reverse transcription reactions were performed in 96 well PCR plate in Eppendorf Mastercycler gradient PCR machine applying corresponding temperature gradient. Synthesized cDNA was analyzed by alkaline agarose gel electrophoresis (staining with ethidium bromide). Samples of cDNA synthesis analysis on alkaline agarose gels are given in FIG. 16.

Results

According to the frequency, with which mutations are found during the evolution of M-MuLV reverse transcriptase, they can be divided into five classes: 21-31 repeats; 14-18 repeats; 4-7 repeats; 2-3 repeats and 1 repeat. Construction of individual reverse transcriptase mutants in general was performed according to this information. Most frequently found mutations were tested first. Reverse transcriptase specific activity at 37° C., relative activity at 50° C. and relative residual activity at 37° C. after 5 min enzyme incubation at 50° C. were determined. In some cases RNase H activity was checked and cDNA synthesis reaction at different temperatures on 1 kb or 4.5 kb RNA was performed. All experimental data on individual mutants are presented in Appendix 5. Second column ("Selection frequency") indicates the number of sequenced mutants, which had exact mutation and the number in the parentheses indicates total number of particular amino acid mutations found in selection. For example D200N—25 (30) means, that aspartate 200 replacement to asparagine was found 25 times out of 30 total D200 mutations. Reverse transcriptase specific activity measured at 37° C. is given in units per mg of protein. Relative enzyme activity at 50° C. and relative residual RT activity at 37° C. after 5 min incubation at 50° C. are given in percents normalized to specific activity (100%) of the same enzyme measured at 37° C. As a control (first line) is given wt M-MuLV reverse transcriptase used for mutants library construction. This primary enzyme is expressed in the same vector and purified in the same way as mutant variants of RT. Specific activity of wt enzyme is about 200,000 u/mg at 37° C., relative activity at 50° C. (comparing to activity at 37° C.)—45-50% (90,000-100,000 u/mg) and relative residual RT activity at 37° C. after 5 min incubation at 50° C. (comparing to activity at 37° C.) is about 11% (~22,000 u/mg). Wild type enzyme has about 160-200 u/mol of RNase H activity and can synthesize full length 1 kb cDNA at 48° C. It is known, that M-MuLV reverse transcriptase is protected from thermal inactivation by the binding to template-primer substrate and contrary, enzyme is less thermostable in solution alone (Gerard et al., 2002). Relative residual RT activity at 37° C. after 5 min incubation at 50° C. directly indicates enzyme thermostability in solution without substrate. Meanwhile relative activity at 50° C. represents enzyme thermostability in complex with RNA/DNA substrate and speed of cDNA synthesis. Fast mutant variant of reverse transcriptase will give increased numbers of polymerase units at 50° C., even if it's thermostability will be the same as wild type enzyme. Highest temperature of cDNA synthesis (in our case 1 kb or 4.5 kb) is the most comprehensive parameter, which represents general ability of enzyme to synthesize cDNA at increased temperatures. Reverse transcriptase mutants, which have at least 10% increased: specific activity at 37° (220,000 u/mg, 200,000 u/mg-wt), relative activity at 50° C. comparing to mutant activity at 37° C. (≥54%, 45-50%-wt) or relative residual activity at 37° C. after 5 min incubation at 50° C. comparing to mutant activity at 37° C. (≥13%, 11%-wt), are shadowed in gray and considered as significantly improved enzymes. Mutants able to synthesize full length 1 kb cDNA at temperatures higher than 48° C. are also shadowed in gray.

Reverse transcriptase mutants with increased specific activity (≥220,000 u/mg) at 37° C. are (Appendix 5):
D200 (D200N—254,000 u/mg; D200G—276,000 u/mg; D200H—234,000 u/mg),
(T330N—223,000 u/mg; T330D—240,000 u/mg),
Q221 (Q221R—268,000 u/mg),
H594 (H594K—270,000 u/mg; H594Q—231,000 u/mg),
D449 (D449E—224,000 u/mg; D449N—221,000 u/mg),
M39 (M39N—349,000 u/mg),
M66 (M66L—237,000 u/mg; M66V—227,000 u/mg; M66I—240,000 u/mg),
H126 (H126R—227,000 u/mg),
W388 (W388R—266,000 u/mg),
I179 (I179V—251,000 u/mg).

Reverse transcriptase mutants with increased relative activity (54%) at 50° C. (comparing to activity at 37° C.) are (Appendix 5):
D200 (D200N—84%; D200A—87%; D200Q—103%; D200E—79%; D200V—131%; D200W—103%; D200G—88%; D200K—102%; D200R—68%; D200H—54%),
L603 (L603W—105%; L603F—104%; L603Y—95%; L603M—77%),
D653 (D653N—93%; D653K—106%; D653A—99%; D653V—98%; D653Q—93%; D653L—83%; D653H—116%; D653G—90%; D653W—93%; D653E—80%),
T330 (T330P—80%; T330N—69%; T330D—55%; T330V—65%; T330S—67%),
Q221 (Q221R—94%; Q221K—77%; Q221E—64%; Q221M—58%; Q221Y—77%),
E607 (E607K—84%; E607A—98%; E607G—72%; E607D—69%),
L139 (L139P—59%),
T287 (T287S—68%),
N479 (N479D—81%),
H594 (H594R—69%; H594K—80%; H594Q—75%; H594N—61%),
D449 (D449G—79%; D449E—77%; D449N—75%; D449A—99%; 0449V—83%),
M39 (M39V—54%; M39N—71%),
M66 (M66L—79%; M66V—73%; M66I—80%),
L333 (L333Q—54%),
H126 (H126R—58%),
P130 (P130S—70%),
Q91 (Q91R—56%),
W388 (W388R—72%),
R390 (R390 W—64%),
Q374 (Q374R—56%),
E5 (E5K—67%).

Reverse transcriptase mutants with increased relative residual activity (≥13%) at 37° C. after 5 min incubation at 50° C. (comparing to activity at 37° C.) are (Appendix 5):
D200 (D200N—15%; D200A—18%; D200Q—23%; D200R—27%; D200H—27%),
L603 (L603W—23%; L603Y—13%; L603P—15%),
D653 (D653N—21%; D653K—15%; D653A—18%; D653V—16%; D653Q—18%; D653H—13%; D653G—13%; D653W—13%; D653E—19%),
T330 (T330P—21%; T330N—13%; T330D—16%; T330S—15%),
T287 (T287A—13%; T287F—13%),
H594 (H594R—14%; H594Q—13%),
D449 (D449G—13%),
M39 (M39V—13%),
M66 (M66L—13%),
Y344 (Y344H—13%),
Q91 (Q91R—13%),
N649 (N649S—16%),
W388 (W388R—14%).

Mutants able to synthesize full length 1 kb cDNA at temperatures higher than 48° C. are (Appendix 5):
D200 (D200N—50.4° C.; D200H—50.4° C.),
L603 (L603W—53.1° C.; L603F—50.4° C.; L603Y—47.8-50.4° C.),
D653 (D653N—50.4-53.1° C.; D653K—50.4-53.1° C.; D653A—50.4° C.; D653V—50.4° C.; D653Q—50.4° C.; D653L—50.4° C.; D653H—50.4-53.1° C.; D653G—50.4° C.; D653W—50.4° C.),
Q221 (Q221R—50.4° C.),
E607 (E607K—47.8-50.4° C.),
H594 (H594K—47.8-50.4° C.; H594Q—47.8-50.4° C.).

Samples of 1 kb cDNA synthesis analysis on alkaline agarose gels are given in FIG. 16 A-D.

According to collected biochemical data most important positions in M-MuLV reverse transcriptase sequence, which can impact cDNA synthesis at increased temperatures, are: D200, L603, D653, T330, Q221, E607, L139, T287, N479, H594, D449, M39, M66, L333, H126, Y344, P130, Q91, N649, W388, R390, I179, Q374, E5.

In general mutations of interest can be combined in between and M-MuLV reverse transcriptase thermostability with and without substrate, velocity, processivity and overall ability to synthesize cDNA at increased temperatures can be further improved. Some data, which illustrates enzyme improvement by combinatorial approach are presented in Appendix 6. Single mutants D200N and L603W have relative activity at 50° C. 84% and 105%. Highest temperatures of 1 kb cDNA synthesis are 50.4° C. and 53.1° C. Double mutant D200N; L603W has relative activity 131% at 50° C. and can synthesize 1 kb cDNA at 56° C. Triple mutant D200N; L603W; T330P (80% at 50° C.; 1 kb cDNA at 47.8° C.) is improved further and has relative activity 175% at 50° C. and can synthesize 1 kb cDNA at 56-58° C. Quadruple mutant D200N; L603W; T330P; E607K (84% at 50° C.; 1 kb cDNA at 47.8-50.1° C.) has relative activity 174% at 50° C. and can synthesize 1 kb cDNA at 60-62° C. Quintuple mutant D200N; L603W; T330P; E607K; L139P (59% at 50° C.; 1 kb cDNA at 47.8° C.) has relative activity 176% at 50° C. and can synthesize 1 kb cDNA at 62° C. and that is about 14° C. higher temperature comparing to wild type M-MuLV reverse transcriptase (1 kb cDNA at 47.8° C.). Additive character of thermostability is also observed in case of:

N479D, H594R mutants (D200N; L603W—131% at 50° C., 1 kb cDNA at 56° C. versus D200N; L603W; N479D; H594R—182% at 50° C., 1 kb cDNA at 56-58° C., 4.5 kb cDNA at 56-58° C.), T330P mutant (D200N; L603W; D653N; D524G—155% at 50° C., 1 kb cDNA at 58-60° C. versus D200N; L603W; D653N; D524G; T330P—180% at 50° C., 1 kb cDNA at 60-62° C.), Samples of 4.5 kb cDNA synthesis analysis on alkaline agarose gels are given in FIG. 16 E-G.

Example 4

Modification of CRD—Selection for DNA Dependent DNA Polymerase Activity Using Biotin-dUTP (Proof of Principle)

This example illustrates activity-based selection strategy of reverse transcriptase as DNA dependent DNA polymerase, which is able to incorporate modified nucleotides into DNA-DNA substrate. The principle scheme of selection is schematically illustrated in FIG. 12. Two plasmids pET_his_MLV_D583N_pD (encoding RNase H minus Moloney Murine Leukemia Virus (M-MLV) reverse transcriptase fused to protein D spacer) and its derivative pET_his_del_pD (encoding inactivated reverse transcriptase; 57 amino acids deletion in pol domain and mutation D583N in RNase H domain, Example 1, SEQ ID No: 2) were used as a starting material in this example. Initial DNA fragments encoding active and inactive reverse transcriptases were synthesized in two separate polymerase chain reactions using plasmids pET_his_MLV_D583N_pD and pET_his_del_pD as a target. Synthesized PCR fragments were used in transcription reaction for synthesis of mRNA, which lacks STOP codon at the 3' end. Purified mRNAs were mixed to a ratio of 1:20=MLV (active RT):del (inactive RT). Double stranded DNA adapter (required for selection of DNA dependent DNA polymerase activity) was ligated to 3' mRNA by T4 DNA ligase. This mRNA-dsDNA complex is used for in vitro translation reaction. The ribosome moving along the mRNA stops translation at the site of RNA-DNA hybridization (Tabuchi et al., 2001). Ribosome-mRNA/dsDNA-protein complexes were stabilized (as in conventional ribosome display) by dilution of translation mixture with ice-cold buffer containing 50 mM $Mg^{2+}$. Mixture of ternary complexes (TC) was purified by ultracentrifugation on sucrose cushions. Purified ternary complexes ($<3*10^9$ molecules taken) containing mRNA-dsDNA linked to in vitro translated M-MuLV (RNase H—) reverse transcriptases were used to prepare reaction mixture additionally supplemented with biotin-dUTP and reaction buffer. Ice-cold reaction mixture was emulsified yielding $~1*10^{10}$ water in oil compartments $~2$ μm in size. Emulsified reaction mixture (less than one TC, ribosome-mRNA/dsDNA-protein per compartment) was incubated for 30 min at 37° C. After the temperature of compartmentalized reaction mixture is raised most of TCs dissociate releasing mRNA/dsDNA and reverse transcriptase. Successful incorporation reaction can occur only in compartments containing active M-MuLV (RNase H—) reverse transcriptase resulting in biotinylation of mRNA/dsDNA complex. Biotinylated complex can be selectively immobilized on streptavidin coated magnetic beads and specifically amplified by RT-PCR. As a result of successful experiment genes encoding active enzyme (in our case RT-PCR fragment of MLV_D583N_pD reverse transcriptase) should be enriched over genes encoding inactive enzyme (del_pD).

Methods and Materials

Production of mRNA/dsDNA Complex.

(1) Determination of Ligation Efficiency.

Efficiency of ligation reaction was determined by ligation of MLV_pD mRNA (synthesized from pET_his_MLV_pD plasmid, Example 1) with primer Long+Tb (SEQ ID No: 23) using ddC-Long2 primer (SEQ ID No: 22) as a splint. The 5' end of Long+Tb was previously phosphorylated using T4 Polynucleotide Kinase (Fermentas).

Annealing mix of 36 μl was prepared by mixing of 8.5 μmol (~10 μg) of purified MLV_pD mRNA with 4 times of molar excess of Long+Tb (SEQ ID No: 23) and 4.2 times of molar excess of ddC-Long2 (SEQ ID No: 22) in nuclease free water. The mixture was incubated at 70° C. for 5 min and then cooled to room temperature for 20 min. Before adding ligation reaction components mixture was moved to cooling stand for 2 min.

4.5 μl of 10× ligation buffer and 4.5 μl of T4 DNA ligase (5v/μl) (Fermentas) were added to 36 μl of annealing mixture. Ligation reaction was performed for 30 min at 37° C. and followed extraction once with equal volume of Roti® Phenol/chloroform (ROTH) and twice with equal volume of chloroform. Assuming that mRNA amount was close to initial amount taken for ligation reaction ~5 μg of ligation products mix was diluted to 43 μl by nuclease free water. Aliquot of 2 μl of resultant mixture was left for analysis on agarose gel before immobilization on Dynabeads M-280 Streptavidin beads (Dynabeads® kilobase BINDER™ Kit (DYNAL Biotech)).

10 μl of resuspended Dynabeads was transferred to a 1.5 ml microcentrifuge tube, washed with 50 μl of Binding Solution provided in the kit. The tube was placed on the magnet for 1-2 min until beads settled at the tube and solution was removed. Dynabeads were gently resuspended by pipetting in 38 μl of Binding Solution supplemented with 2 μl of aqueous tRNA (tRNA from yeast (Roche)) solution (1 μg/μl) to minimize non-specific mRNA binding. 40 μl of Dynabeads in Binding solution was added to solution (~40 μl) containing ligation products mix. The tube was incubated shaking at the +22° C. in termomixer (Eppendorf) for 60 min. After the binding of ligated mRNA/dsDNA, supernatant was removed and the beads were washed three times with 50 μl of Washing Solution (supplied in the kit). Collected Dynabeads with immobilizes ligated mRNA/dsDNA complex was resuspended in 26 μl of nuclease free water and followed extraction once with 40 μl of Roti® Phenol/chloroform (ROTH) and twice with 40 μl volume of chloroform to release mRNA/dsDNA complex from magnetic beads. 1; 2 and 5 μl of final mix were analysed on agarose gel along with sample (2 μl) left before immobilization and Mass Ruler™ High Range DNA ladder. Amount of mRNA in mRNA/DNA complex purified on streptavidin beads was determined comparing mRNA amounts before and after the immobilization. The yield of recovered mRNA was ~60%, what means that at least 60% of mRNA was successfully ligated with DNA duplex, resulting in mRNA/dsDNA complex.

(2) Determination of Biotin-dUTP Incorporation Efficiencies into mRNA/dsDNA Complex and into Self Primed mRNA.

As it was shown in first mRNA to dsDNA ligation experiment ligation reaction efficiency is ~60% and more. Free mRNA left in ligation mixture can self prime and participate in extension reaction using M-MuLV reverse transcriptase and biotin-dUTP. This experiment was performed in order to demonstrate that mRNA/dsDNA complex (ligation product) is better substrate than free self primed mRNA.

MLV_D583N_pD mRNA was ligated with long+ oligonucleotide (SEQ ID No: 21) according procedure described above (construction of initial plasmids pET_his_MLV_D583N_pD and pET_his_delpD in details is described in Example 1). ~12.5 ng of prepared (MLV_D583N_pD mRNA/long+) substrate was combined with ~12.5 ng of del_pD mRNA previously incubated at 70° C. for 5 min, then cooled to room temperature for 20 min in nuclease free water, in total volume of 12.5 μl. The second mix for dTTP or biotin-dUTP incorporation by reverse transcriptase was prepared: 8 μl of 5× Reaction buffer for reverse transcriptase; 1 μl-40 u/μl RiboLock™ RNase inhibitor (Fermentas); 18.6 μl nuclease-free water; 0.4 μl-200 u/μl RevertAid™ Minus M-MuLV Reverse transcriptase (Fermentas). Prepared mix was divided to two tubes 2×15 μl and 1 μl of 1 mM dTTP (Fementas) or 1 μl of 1 mM biotin-dUTP (Fermentas) was added. Subsequentially 5 μl of substrate (from the first mix) was added to dTTP and biotin-dUTP containing mixtures. Reactions were carried out at 37° C. for 60 min. After that 1 μl of 0.5M EDTA (pH 8.0) was added to both samples and reaction mixtures were extracted once with equal volume of Roti® Phenol/chloroform (ROTH) and once with equal volume of chloroform followed by purification on G-50 MicroColumns (GE Healthcare). 2 μl of resultant reaction products were left for direct RT reaction (without streptavidin beads purification) and the remaining part of solutions were used for biotinylated mRNA-dsDNA complex immobilization on Dynabeads M-280 Streptavidin beads (Dynabeads® kilobase BINDER™ Kit (DYNAL Biotech)). 10 μl of resuspended Dynabeads was transferred to a 1.5 ml microcentrifuge tube, washed with 25 μl of provided Binding Solution. The tube was placed on the magnet for 1-2 min until beads settled at the bottom of the tube and solution was removed. Dynabeads were gently resuspended by pipetting in 90 μl of Binding Solution and 2 μl of aqueous tRNA (tRNA from yeast (Roche)) solution (1 μg/μl) was added to minimize non-specific mRNA binding. 40 μl of Dynabeads in Binding solution was added to solution (~40 μl) containing the elongated by dTTP and biotin-dUTP RNA-DNA fragments. The tubes were incubated at the +22° C. in termomixer (Eppendorf) for 40 min by shaking (1400 rpm). After the binding step, supernatant was removed and the beads were washed three times with 50 μl of Washing Solution (provided in the kit) shaking (1400 rpm) for 5 min at +22° C. Collected Dynabeads with immobilizes elongated mRNA-dsDNA complex was resuspended in reverse transcription reaction mixture. Reverse transcription reaction mixture was prepared on ice: 20 μl-5× reaction buffer for Reverse Transcriptase (Fermentas); 10 μl-10 mM dNTP (Fermentas); 2.5 μl-40 u/□l RiboLock RNase inhibitor (Fermentas); 5 μl-20 μM pD_42 oligonucleotide (SEQ ID No: 8); 2.5 μl RevertAid™ Minus M-MuLV Reverse transcriptase (200 u/μl) (Fermentas); 55 μl nuclease-free water. Prepared mix was divided to five 19 □l (5×19 □l) aliquots: two were used to resuspend Dynabeads with immobilized elongated mRNA/dsDNA complex or mRNA, the other two were transferred to the tubes with samples left without streptavidin beads purification and to the rest of 19 □l aliquot was added 1 □l of nuclease free wateregative reaction control to prove, that reaction mixture is not contaminated by DNA. All reaction mixtures were incubated by shaking (1000 rpm) at the +42° C. in termomixer (Eppendorf) for 1 hour until cDNA synthesis reaction was finished.

Amplification of cDNA was performed by nested PCR. Initial PCR mixture was prepared on ice: 14 μl-10× Taq buffer with KCl (Fermentas); 14 μl-2 mM of each dNTP (Fermentas); 8.4 μl-25 mM MgCl₂ (Fermentas); 2.8 μl-1 u/μl LC (recombinant) Taq DNA Polymerase (Fermentas); 0.7 μl-100 μM M_F primer (SEQ ID No: 11); 0.7 μl-100 μM M_2R primer (SEQ ID No: 12); 92.4 μl water-mixture was divided into 7 samples for 19 μl (7×19 μl). To 5×19 μl of PCR master mix were added 1 μl of cDNA (1-5 RT samples); to the 6'ʰ tube of PCR master mix 1 μl of water was added—negative PCR control; to the 7'ʰ tube (positive PCR control)—1 μl of pET_his_MLV_D583N_pD plasmid (~1 ng) was added. The cycling protocol was: initial denaturation step 3 min at 94° C., 25 cycles (45-sec at 94° C., 45 sec at 57° C., and 1 min at 72° C.) and final elongation 3 min at 72° C.

Predicted amplicons size 907 bp for MLV_D583N_pD and 736 bp for del_pD cDNA. PCR products were analyzed on 1% agarose gel loading 10 μl of PCR mix per well (FIG. 13).

As it was expected efficient cDNA amplification is observed only in elongation reaction with biotin-dUTP. Very faint bands of amplified cDNA can be detected in elongation reaction with dTTP and can be explained by weak nonspecific binding of mRNA to streptavidin beads. After purification on streptavidin beads DNA encoding MLV_D583N_pD gene (907 bp) is enriched over DNA of del_pD (736 bp). That means mRNA/dsDNA complex is elongated by biotin-dUTP much more efficiently than self primed del_pD mRNA.

(3) Preparation of mRNA Mixture (MLV_D583N_pD: del_pD=1:20) and RNA/dsDNA Complex.

Preparation of PCR fragments for in vitro transcription. PCR mixture was prepared on ice: 20 μl-10× Taq buffer with KCl (Fermentas); 20 μl-2 mM of each dNTP (Fermentas); 12 μl-25 mM MgCl₂ (Fermentas); 16 μl—DMSO (D8418—Sigma); 4 μl-1 u/μl LC (recombinant) Taq DNA Polymerase (Fermentas); 1 μl-100 μM pro-plVEX primer (SEQ ID No: 3); 1 μl-100 μM pD-ter—primer (SEQ ID No: 20); 122 μl water-mixture divided into two tubes 2×98 μl. To 2×98 μl of PCR master mix were added either 2 μl of pET_his_MLV_D583N_pD (diluted to ~1 ng/μl) or 2 μl of pET_his_del_pD (diluted to ~1 ng/μl) (construction of initial plasmids pET_his_MLV_D583N_pD and pET_his_del_pD in details is described in Example 1). The cycling protocol was: initial denaturation step 3 min at 94° C., 30 cycles (45 sec at 94° C., 45 sec at 53° C., and 2 min at 72° C.) and final elongation 5 min at 72° C. Amplification efficiency was ~7000 fold from 2 ng of plasmid (7873 bp) target to ~5 μg (50 ng/μl) of amplified product (2702 bp PCR fragment MLV_D583N_pD from pET_his_MLV_D583N_pD; 2531 bp PCR fragment del_pD from pET_his_del_pD).

Transcription mixture was prepared: 80 □l-5×T7 transcription buffer (1 M HEPES-KOH pH 7.6; 150 mM Mg acetate; 10 mM spermidin; 0.2 M DTT); 56 □l-112 mM of each NTP (Fermentas); 16 □l-20 u/□l T7 RNA polymerase (Fermentas); 8 □l-40 u/□l RiboLock RNase inhibitor (Fermentas); 114 □l nuclease-free water-mixture divided into two tubes 2×165 □l and add 35 □l-20 ng/□l of PCR fragment MLV_D583N_pD (unpurified PCR mixture) or 35 µl-20 ng/µl of PCR fragment del_pD PCR (unpurified PCR mixture). Transcription was performed 2 hr at 37° C.

Both transcription mixtures were diluted to 200 µl with ice-cold nuclease-free water and 200 µl of 6 M LiCl solution were added. Mixtures incubated 25 min at +4° C. and centrifuged for 25 min at +4° C. in cooling centrifuge at max speed (25,000 g). Supernatant was discarded and RNA pellet washed with 500 µl of ice-cold 75% ethanol. Tubes were centrifuged again for 5 min at +4° C. at max speed and supernatant was discarded. RNA pellet was dried for 5 min at room temperature and subsequently resuspended in 400 µl of nuclease-free ice-cold water by shaking for 15 min at +4° C. and 1400 rpm. Tubes were centrifuged again for 5 min at +4° C. at max speed to separate not dissolved RNA. About 380 µl of supernatant were transferred to new tube with 42 µl of 10× DNase I buffer ($Mg^{2+}$) (Fermentas); 3 µl-1 u/µl DNaseI (RNase-free) (Fermentas) and incubated for 20 min at +37° C. to degrade DNA. Reaction mixtures were extracted once with equal volume of Roti® Phenol/chloroform (ROTH) and twice with equal volume of chloroform to remove DNaseI. 43 µl of 3 M Sodium acetate pH 5.0 solution and 1075 µl of ice-cold 96% ethanol were added to each tube. Finally RNA was precipitated by incubation for 30 min at −20° C. and centrifugation for 25 min at +4° C. at max speed (25,000 g). Supernatant was discarded and RNA pellet washed with 500 µl of ice-cold 75% ethanol. Tubes were centrifuged again for 4 min at +4° C. at max speed and supernatant was discarded. RNA pellet was dried for 5 min at room temperature and subsequently resuspended in 150 µl of nuclease-free ice-cold water by shaking (1400 rpm) for 15 min at +4° C. RNA solution was aliquot for 10 µl and liquid nitrogen frozen. Concentration of mRNA was measured spectrophotometrically and double-checked on agarose gel along with RiboRuler™ RNA Ladder, High Range (Fermentas).

mRNA/dsDNA complex was produced by ligation of long+ oligodeoxynucleotide to mRNA using ddC-Long2 oligodeoxynucleotide as a splint. The 5' end of long+ was previously phosphorylated using T4 Polynucleotide Kinase (Fermentas). Oligodeoxynucleotide ddC-Long2 has 3' end modification (ddC) in order to prevent possibility of 3' end extension by reverse transcriptase on its natural RNA-DNA substrate. Annealing mix of 50 µl was prepared by mixing of 17 µmol of purified mRNA mixture at ratio of 1:20=MLV_D583N_pD (active RT): del_pD (inactive RT) with 4.3 time of molar excess of long+ and 4.1 time of molar excess of ddC-Long2 in nuclease free water. The mixture was incubated at 70° C. for 5 min and then cooled to room temperature for 20 min. Before adding ligation reaction components mixture was moved to cooling stand for 2 min.

5 µl of 10× ligation buffer and 5 µl of T4 DNA ligase (5 v/µl) (Fermentas) were added to 40 µl of annealing mixture. Negative ligation reaction was carried out using the same annealing mixture in 1× ligation buffer without T4 DNA ligase. Prepared ligation reaction mixtures were incubated at 37° C. for 30 min. To stop ligation 1 µl of 0.5M EDTA (pH 8.0) was added to both tubes and reaction mixtures were extracted once with equal volume of Roti® Phenol/chloroform (ROTH) and twice with equal volume of chloroform followed by concentration of reaction products at 30° C. for 10 min in vacuum Concentrator 5301 (Eppendorf). Desalting was performed using illiustra ProbeQuant G-50 MicroColumns (GE Healthcare). Concentrations of ligation products were determined on agarose gel along with RiboRuler™ RNA Ladder, High Range (Fermentas)—mRNA mixture (MLV_D583N_pD:del_pD=1:20) ligated to long+/ddC-Long2 oligodeoxynucleotides ~0.24 µg/µl (sample with T4 DNA ligase) and simple mRNA mixture with long+/ddC-Long2 oligodeoxynucleotides ~0.06 µg/µl (sample without T4 DNA ligase).

(4) General Control of mRNA/dsDNA Complex by Incorporation of [α-$P^{33}$]dATP.

Prepared mRNA/dsDNA complex (substrate) was tested for dTTP (or biotin-dUTP) and subsequent [α-$P^{33}$]dATP incorporation by reverse transcriptase. Reaction mixture: 16 µl of 5× Reaction buffer for reverse transcriptase; 4 µl-40 u/µl RiboLock™ RNase inhibitor (Fermentas); 2 µl [α-$P^{33}$]dATP (10 mCi)/ml, SRF-203 (Hartmann Analytic)); 35 µl nuclease free water; 1 µl-200 u/µl RevertAid™ Minus M-MuLV Reverse transcriptase (Fermentas). Prepared mix was divided to two tubes 2×28 µl and 2 µl of 1 mM dTTP (Fermentas) or 2 µl of 1 mM biotin-dUTP (Fermentas) was added. Resultant mixtures were divided to two tubes 2×15 µl. To first tube 1.25 µl (~0.3 µg) of ligation products plus 3.75 µl of nuclease free water were added. To second tube 5 (~0.3 µg) of negative ligation reaction products were added. Reaction mixtures were incubated at 37° C. for 30 min. After that, 1 µl of 0.5M EDTA (pH 8.0) was added to all tubes and reaction mixtures were extracted once with equal volume of Roti® Phenol/chloroform (ROTH) and twice with equal volume of chloroform followed by purification on illiustra ProbeQuant G-50 MicroColumns (GE Healthcare). Reactions products were analyzed on agarose gel along with RiboRuler™. RNA Ladder, High Range (Fermentas) FIG. 14A. In all samples (with and without ligase) we can see discreet band (~2500b) of del_pD mRNA (20 times smaller amount of MLV_D583N_pD mRNA ~2700b, which was present in mRNA mixture can not be distinguished). Subsequently agarose gel was dried on filter paper and radiolabeled mRNA/dsDNA complex (at the same position as mRNA) was detected only in case of positive ligation samples (with ligase) and not in case of negative ligation samples (without ligase) FIG. 14B.

(5) Selection for DNA Dependent DNA Polymerase Activity Using Biotin-dUTP.

Previously prepared mRNA/dsDNA complex (mRNA mix MLV_D583N_pD (active RT):del_pD (inactive RT)=1:20) was used for in vitro translation employing synthetic Wako-PURE system (295-59503—Wako). Translation mixture for WakoPURE system (25 µA: 12.5 µl—A solution (Wako); 5 µl—B solution (Wako); 0.5 µl-40 u/µl RiboLock RNase inhibitor (Fermentas); 0.25 µl-1 M DTT; 1.75 µl nuclease-free water and 5 µl-0.24 µg/µl mRNA/dsDNA substrate (~1200 ng). In vitro translation was performed for 120 min at 37° C.

Translations (~25 µl) was stopped by adding 155 µl of ice-cold stop buffer $WBK_{500}$+DTT+triton (50 mM Tris-acetate pH 7.5 at 25° C.; 50 mM NaCl; 50 mM Mg-acetate; 500 mM KCl; 10 mM DTT; 0.1% (v/v)-Triton X-100 (T8787—Sigma)) and centrifuged for 5 min at +4° C. and 25,000 g. Very carefully 160 µl of centrifuged translation mixture was transferred on the top of 840 µl 35% (w/v) sucrose solution in $WBK_{500}$+DTT+Triton X-100 (50 mM Tris-acetate pH 7.5 at 25° C.; 50 mM NaCl; 50 mM Mg-acetate; 500 mM KCl; 10 mM DTT; 0.1% (v/v)—Triton X-100 (T8787—Sigma); 35% (w/v)—sucrose (84097—Fluka)) to transparent 1 ml ultra-centrifugation tubes (343778—Beckman). Ternary complexes (TC) consisted of mRNA/dsDNA-ribosome-protein (tRNA) were purified by ultracentrifugation at TL-100 Beckman ultracentrifuge in TLA100.2 fixed angle rotor (Beckman) at 100,000 rpm for 9 min at +4° C. Initially 750 µl of solution was removed from the very top of the centrifugation tube. Then (very carefully to keep small transparent pellet of TC at the bottom of ultracentrifugation tube intact)

tube walls were washed with 750 μl of WBK$_{500}$ (50 mM tris-acetate pH 7.5 at 25° C.; 50 mM NaCl; 50 mM Mg-acetate; 500 mM KCl). Finally all solution was removed starting from the very top of the centrifugation tube and pellet was dissolved in 30 μl of ice-cold stop buffer WBK$_{500}$+DTT+ triton (50 mM Tris-acetate pH 7.5 at 25° C.; 50 mM NaCl; 50 mM Mg-acetate; 500 mM KCl; 10 mM DTT; 0.1% (v/v)—Triton X-100 (T8787—Sigma)).

As it was determined using radioactively labeled mRNA after ultracentrifugation 5%-30% of input mRNA is located in ternary complex pellet. Therefore it was predicted to have less than 360 ng (30% from 1200 ng mRNA used in translation reaction) of mRNA in 30 μl of buffer (~12 ng/μl or 9*10$^9$ molecules/μl of ternary complex).

Modified nucleotide incorporation reaction mix was prepared on ice by mixing: 5 μl-5× reaction buffer for Reverse Transcriptase (Fermentas); 1.25 μl-40 u/□l RiboLock RNase inhibitor (Fermentas); 2.5 μl-1 mM biotin-dUTP (Fermentas); 40.95 μl nuclease-free water and 0.3 μl of purified (<2.7*10$^9$ molecules) TC. According to the protocol 50 μl of nucleotide incorporation reaction mix contains <2.7*10$^9$ molecules of ternary complex.

Oil-surfactant mixture was prepared by mixing ABIL EM 90 (Goldschmidt) into mineral oil (M5904—Sigma) to final concentration of 4% (v/v) (Ghadessy and Holliger, 2004; US2005064460). Emulsions were prepared at +4° C. in 5 ml cryogenic vials (430492—Corning) by mixing 950 μl of oil-surfactant mixture with 50 μl of RT mixture. Mixing was performed using MS-3000 magnetic stirrer with speed control (Biosan) at ~2100 rpm; Rotilabo®—(3×8 mm) magnetic bar with centre ring (1489.2—Roth); water phase was added in 10 μl aliquots every 30 sec, continuing mixing for 2 more minutes (total mixing time—4 min). According to optical microscopy data compartments in prepared emulsions vary from 0.5 μm to 10 μm in size with average diameter of ~2 μm. Therefore it was expected to have ~1*10$^{10}$ water in oil compartments after the emulsification of 50 μl reverse transcription reaction mixture, which contains less than 2.7*10$^9$ molecules of ternary complex (about one mRNA-dsDNA complex and reverse transcriptase molecules per 3-4 compartments).

Prepared emulsion was incubated 30 min at +37° C.

To recover the reaction mixture from emulsion 20 μl of 0.1 M EDTA was added to emulsion, stirred for 10 sec, then 50 μl phenol/chloroform mix was added and stirred for additional 10 sec. After that, emulsion was transferred to 1.5 ml microcentrifuge tube, 0.5 ml of water-saturated ether was added mixed by vortexing and centrifuged for 10 min at room temperature for 16,000 g. Oil-ether phase was removed leaving concentrated (but still intact) emulsion at the bottom of the tube. Finally emulsions were broken by extraction with 0.9 ml water-saturated ether; 0.9 ml water-saturated ethyl-acetate (in order to remove ABIL EM 90 detergent) and twice 0.9 ml water-saturated ether. Water phase was dried for 12 min under vacuum at room temperature followed removal of incorporated nucleotides on illiustra ProbeQuant G-50 MicroColumns (GE Healthcare). 2 μl aliquot of resultant mixture was left for direct RT reaction (without streptavidin beads purification) and the remaining part of solution was used for biotinylated mRNA/dsDNA complex immobilization on Dynabeads M-280 Streptavidin beads (DYNAL Biotech).

Dynabeads® kilobase BINDER™ Kit (DYNAL Biotech) was used for isolation of biotinylated mRNA-dsDNA complex according provided product description. 5 μl of resuspended Dynabeads was transferred to a 1.5 ml microcentrifuge tube, washed with 20 μl of provided Binding Solution. The tube was placed on the magnet for 1-2 min until beads settled at the tube and solution was removed. Dynabeads were gently resuspended by pipetting in 50 μl of Binding Solution and 1 μl of aqueous tRNA (tRNA from yeast (Roche)) solution (1 μg/μl) was added to minimize non-specific mRNA binding. 50 μl of Dynabeads in Binding solution were added to solution (~50 μl) containing the biotinylated RNA-DNA fragments. The tube was incubated shaking at the +22° C. in termomixer (Eppendorf) for 1 hour. After the binding of mRNA/dsDNA, supernatant was removed from the beads, and the beads were washed two times with 50 μl of Washing Solution (provided in the kit) shaking (1400 rpm) for 5 min at +22° C. and once with 50 μl of Washing Solution shaking (1400 rpm) for 12 min at +22° C. Collected Dynabeads with immobilized biotinylated mRNA/dsDNA complex were resuspended in reverse transcription reaction mixture.

Reverse transcription reaction mixture for selected mRNA/dsDNA complex was prepared on ice: 12 μl-5× reaction buffer for Reverse Transcriptase (Fermentas); 6 μl-10 mM dNTP (Fermentas); 1.5 μl-40 u/□l RiboLock RNase inhibitor (Fermentas); 0.3 μl-20 μM pD_42 oligonucleotide (SEQ ID No: 8); 1.5 μl RevertAid™ Minus M-MuLV Reverse transcriptase (200 u/μl) (Fermentas); 35.7 μl nuclease-free water. Prepared mix was divided to three 19 □l aliquots: one was used to resuspend Dynabeads with immobilized biotinylated mRNA/dsDNA complex, the other aliquot of 19 μl was transferred to the tube with sample of elongated mRNA/dsDNA complex left without streptavidin beads purification and to the rest of 19 □l aliquot was added 1 □l of nuclease free water (negative reaction control—to prove that reaction mixture is not contaminated). All reaction mixtures were incubated by shaking (1000 rpm) at the +42° C. in termomixer (Eppendorf) for 1 hour.

Amplification of cDNA was performed by nested PCR. Initial PCR mixture was prepared on ice: 10 μl-10× Taq buffer with KCl (Fermentas); 10 μl-2 mM of each dNTP (Fermentas); 6 μl-25 mM MgCl$_2$ (Fermentas); 2 μl-1 u/μl LC (recombinant) Taq DNA Polymerase (Fermentas); 1-2.5 u/μl Pfu DNA Polymerase (Fermentas); 0.5 μl-100 μM RD_Nde primer (SEQ ID No: 9); 0.5 μl-100 μM pD_55 primer (SEQ ID No: 10); 65 μl water-mixture was divided into 5 samples for 19 μl (5×19 μl). To 3×19 μl of PCR master mix were added 1 μl of cDNA (1-3 RT samples); to one tube with 19 μl of PCR master mix 1 μl water was added—negative PCR control. For positive PCR control 1 μl of pET_his_MLV_pD plasmid (~1 ng) was added. The cycling protocol was: initial denaturation step 3 min at 94° C., 30 cycles (45 sec at 94° C., 45 sec at 58° C., and 3 min at 72° C.) and final elongation 5 min at 72° C.

Nested PCR mixture for partial gene amplification (for better resolution of MLV_D583N_pD:del_pD cDNA ratio in RT samples) was prepared on ice: 20 μl-10× Taq buffer with KCl (Fermentas); 20 μl-2 mM of each dNTP (Fermentas); 12 μl-25 mM MgCl$_2$ (Fermentas); 0.9 μl-5 u/μl Taq DNA Polymerase (Fermentas); 1.0 μl-100 μM M_F primer (SEQ ID No: 11); 1.0 μl-100 μM M_2R primer (SEQ ID No: 12); 135.1 μA water-mixture was divided 5×38 μl. 2 μl of first PCR (primers set RD_Nde//pD_55) product were added to prepared nested PCR mixture. Master mix was mixed again and divided into two tubes (2×20 μl) for 30 or 35 PCR cycles amplification. The cycling protocol was: initial denaturation step 3 min at 94° C., 30 or 35 cycles (45 sec at 94° C., 45 sec at 57° C., and 1 min at 72° C.) and final elongation 3 min at 72° C. Expected length of PCR fragments was 907 bp for MLV_D583N_pD and 736 bp for del_pD. Amplification was analyzed on 1% agarose gel loading 10 μl of PCR mix per well (FIG. 15).

Results

1. Double stranded (dsDNA) adaptor was successfully ligated to mRNA using T4 DNA ligase. Ligation efficiency is about 60% as it was determined by ligation of dsDNA-biotin adapter. mRNA/dsDNA complex can be specifically purified on streptavidin beads, providing an opportunity to discriminate between biotin labelled and unlabelled substrates. Free mRNA is much worse substrate for DNA dependent DNA polymerase comparing to mRNA/dsDNA. As a consequence 60% ligation efficiency of dsDNA to mRNA is good enough and such a substrate can be successfully used in evolution scheme.

2. General selection experiment using mRNA/dsDNA complex (mRNA mixture MLV_D583N_pD:del_pD=1:20) was performed. In vitro translation was performed using WakoPURE protein translation system and compartmentalized biotin-dUTP incorporation reaction in to dsDNA was carried out to demonstrate the enrichment of genes encoding active (MLV_D583N_pD) reverse transcriptase over genes encoding inactivated enzyme (del_pD). According to selection scheme (FIG. 12) incorporation reaction of biotin-dUTP should occur only in aqueous compartments containing active (MLV_D583N_pD) reverse transcriptase resulting in biotinylation of mRNA/dsDNA complex. DNA dependent DNA polymerase is selected by binding of the biotinylated complex to streptavidin immobilized on magnetic beads, and then the selected gene-is amplified by RT-PCR. Genes encoding active enzyme (in our case RT-PCR fragment for MLV_D583N_pD reverse transcriptase) were enriched over genes encoding inactive enzyme (FIG. 15). Initial ratio of genes MLV_D583N_pD:del_pD was 1:20 and final ratio (after enrichment) was ~1:1. Respectively an enrichment factor in this particular experiment was ~20 folds. Enrichment factors calculated from different experiments varied in range from 5 to 200. And it was confirmed that DNA dependent DNA polymerase could be selected for modified nucleotide incorporation applying Compartmentalized Ribosome Display (CRD) method. Selection of conventional DNA dependent DNA polymerases can be performed straight away. Biotin-dUTP can be exchanged to different nucleotide analogues of interest including nucleotide analogues having 3' modifications. After the incorporation of such nucleotide analogues into DNA strand 3' end is blocked, can't be extended and elongation reaction will be terminated. This approach is used in sequencing by synthesis (SBS) scheme and DNA polymerase suitable for SBS can be easily evolved using compartmentalized ribosome display (CRD) technique.

NcoI
```
ccatgggcatgaccctaaatatagaagatgagcatcggctacatgagacctcaaaagagc    60
cagatgtttctctagggtccacatggctgtctgatttcctcaggcctgggcggaaaccg   120
ggggcatgggactggcagttcgccaagctcctctgatcatacctctgaaagcaacctcta   180
cccccgtgtccataaaacaatacccatgtcacaagaagccagactggggatcaagcccc   240
                g                              g
acatacagagactgttggaccagggaatactggtaccctgccagtcccctggaacacgc   300
                        a
ccctgctacccgttaagaaaccagggactaatgattataggcctgtccaggatctgagag   360
                                     g                g
aagtcaacaagcgggtggaagacatccaccccaccgtgcccaaccccttacaacctcttga   420
                      c
gcgggctcccaccgtcccaccagtggtacactgtgcttgatttaaaggatgcctttttct   480
              c
gcctgagactccaccccaccagtcagcctctcttcgcctttgagtggagagatccagaga   540
tgggaatctcaggacaattgacctggaccagactcccacagggtttcaaaaacagtccca   600
                      c                        t    t
ccctgtttgatgaggcactgcacagagacctagcagacttccggatccagcacccagact   660
                    g
tgatcctgctacagtacgtggatgacttactgctggccgccacttctgagctagactgcc   720
aacaaggtactcgggccctgttacaaaccctagggaacctcgggtatcgggcctcggcca   780
            g                        c
agaaagcccaaatttgccagaaacaggtcaagtatctgggggtatcttctaaaagagggtc   840
              a
agagatggctgactgaggccagaaaagagactgtgatggggcagcctactccgaagaccc   900
                                  a
ctcgacaactaagggagttcctagggacggcaggcttctgtcgcctctggatccctgggt   960
ttgcagaaatggcagccccttgtaccctctcaccaaaacggggactctgtttaattggg  1020
gcccagaccaacaaaggcctatcaagaaatcaagcaagctcttctaactgccccagccc  1080
                                c
tggggttgccagatttgactaagccctttgaactctttgtcgacgagaagcagggctacg  1140
ccaaaggtgtcctaacgcaaaaactgggaccttggcgtcggccggtggcctacctgtcca  1200
aaaagctagacccagtagcagctgggtggcccccttgcctacggatggtagcagccattg  1260
ccgtactgacaaaggatgcaggcaagctaaccatgggacagccactagtcattctggccc  1320
-------                  -------------------
cccatgcagtagaggcactagtcaaacaaccccccgaccgctggctttccaacgcccgga  1380
tgactcactatcaggccttgcttttggacacggaccgggtccagttcggaccggtggtag  1440
ccctgaacccggctacgctgctcccactgcctgaggaagggctgcaacacaactgccttg  1500
                                  g
atatcctggccgaagcccacggaacccgacccgacctaacggaccagccgctcccagacg  1560
                    c                c
ccgaccacacctggtacacggatggaagcagtctcttacaagagggacagcgtaaggcgg  1620
gagctgcggtgaccaccgagaccgaggtaatctgggctaaagccctgccagccgggacat  1680
ccgctcagcgggctgaactgatagcactcacccaggccctaaagatggcagaaggtaaga  1740
                                                g
agctaaatgtttatactgatagccgttatgcttttgctactgcccatatccatggagaaa  1800
tatacagaaggcgtggttgctcacatcagaaggcaaagagatcaaaaataaagacgaga  1860
tcttggccctactaaaagccctctttctgcccaaaagacttagcataatccattgtccag  1920
              a                  g
gacatcaaaagggacacagcgccgaggctagaggcaaccggatggctgaccaagcggccc  1980
gaaaggcagccatcacagagactccagacacctctaccctcctcatagaaaattcatcac  2040
ccaattcccgcttaattaatgaattc
            EcoRI
```

```
MLV   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
1     1   TLNIEDEHRL HETSKEPDVS LGSTWLSDFP QAWAETGGMG LAVRQAPLVI PLKATSTPVS
IKQYPMSQEA RLGIKPHIQR LLDQGILVPC QSPWNTPLLP
3     1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
5     1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
7     1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
8     1   TLNIEDEHRL HETSKEPDVS LGSTWLSDFP QAWAETGGMG LAVRQAPLII PLKATSTPVS
IKQYPMSQEA RLGIKPHIQR LLDQGILVSC QSPWNTPLLP
10    1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
11    1   TLNIEDEHRL HETSKEPDVS LGSTWLSDLP QAWAETGGMG LAVRQAPLII PLKATSTPVS
IKQYPMSQEA RLGIKPHIQR LLDQGILVPC QSPWNTPLLP
12    1   TLNIEDEHRL HETSKEPDVS LGPTWLSDFP QAWAETGGMG LAVRQAPLII PLKATSTPVS
IKQYPMSQEA RLGIKPHIQR LLDQGILAPC QSPWNTPLLP
13    1   TLNIEDEHRL HETSKEPDVS LGSTWLSDFP QAWAETGGMG LAVRQAPLII SLKATSTPVS
IKQYPMSQEA RLGIKPHIQR LLDQGILVPC QSPWNTPLLP
16    1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
17    1   TLNIEDEHRL HETSKEPDVS LGSTWLSDFP QAWAETGGMG LAVRQAPLVI PLKATSTPVS
IKQYSMSQEA RLGIKPHIQR LLDQGILVPC QSPWNTPLLP
18    1   TLNIEDEHRL HETSKEPDVS LGSTWLSDFP QAWAETGGMG LAVRQAPLII PLKATSTPVS
IKQYPMSQEA RLGIKPHIQR LLNQGILVPC QSPWNTPLLP
20    1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
21    1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
23    1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
28    1   TLNIEDERRL HETSKEPDVS LGSTWLSDFP QAWAETGGMG LAVRQAPLII PLKATSTPVS
IKQYPMSQEA RLGIKPHIQR LLDQGILVPC QSPWNTPLLP
30    1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
L5_1  1   TLNIEDEHRL HETSKEPDVS LGSTWLSDFP QAWAETGGMG LAVRQAPLII PLKATSTPVS
IKQ PMSQEA RLGIKPHIQR LLDQGILVPC QSPWNTPLLP
L5_2  1   TLNIKDEHRL HETSKEPDVS LGSTWLSDFP QAWAETGGMG LAIRQAPLII PLKATSTPVS
IKQYPMSQEA RLGIKPHIQR LLDQGILVPC QSPWNTPLLP
L5_3  1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
L5_4  1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
L5_6  1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
L5_8  1   TLNIEDEHRL HETSKEPDVS LGSTWLSDFP QAWAETGGMG LAVRQAPLII PLKATSTPVS
IKQYPMSQEA RLGIKPHIQR LLDQGILVPC QSPWNTPLLP
L5_9  1   TLNIEDEHRL HETSKEPDVS LGSTWLSDFP QAWAETGGMG LAVRQAPLII PLKATSTPVS
IKQYPMSQEA RLGIKPHIQR LLNQGILVPC QSPWNTPLLP
L5_11 1   TLNIEDEHRL HETSTEPDVS LGSTWLSDFP QAWAETGGMG LAVRQAPLII
PLKATSTPVS IKQYPMSQEA RLGIKPHIQR LLDQGILVPC QSPWNTPLLP
L5_13 1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_14 1   TLNIEDEHRL HETSKEPDVS LGSTWLSDFP QAWAETWGMG LAVRQAPLII
PLKATSTPVS IKQYPMSQEA RLGIKPHIQR LLDQGILVPC QSPWNTPLLP
```

| L5_15 | 1 | TLNIEDEHRL HETSKESDVS LGSTWLSDFP QAWAETGGMG LAVRQAPLII PLKATSTPVS IKQYPMSQEA RLGIKPHIQR LLD@GILVPC QSPWNTPLLP |
|---|---|---|
| L5_16 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC LSPWNTPLLP |
| L5_18 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_20 | 1 | TLNIEDEHRL HATSKEPDVS LGSTWLSDFP QAWAETGGMG LAVRQAPLII PLKATSTPVS IKQYPMSQEA RLGIKPHIQR LLD@GIPVPC QSPWSTPLLP |
| L5_21 | 1 | TLNIEDEHRL HETSKEPDVS LGSTWLSDFP QAWAETGGMG LAVRQAPLII PLKATSTPVS IKQYSMSQEA RLGIKPHIQR LLD@GILVPC QSPWNTPLLP |
| L5_23 | 1 | TLNIEDEHRL HETSKEPDVS LGSTWLSDFL QAWAETGGMG LAVRQAPLII PLKATSTPVS IKQYPMSQEA RLGIKPHIQR LLD@GILVPC QSPWNTPLLP |
| L5_24 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_25 | 1 | TLNIEDEHRL HETSKEPDVS LGSTWLSDFP QAWAETGGLG LAVRQAPLII PLKATSTPVS IKQYPMSQEA RLGIKPHIQR LLD@GILVPC QSPWNTPLLP |
| L5_28 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_29 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_30 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_32 | 1 | TLNIEDEHRL HETSKEPDVS LGSTWLSDFP QAWAETGGMG LAVRQAPLII PLKATSTPVS IKQYPMSQGA RLGIKPHIQR LLD@GILVPC QSPWNTPLLP |
| L5_35 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_37 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_39 | 1 | TLNIEDEHRL HVTSKEPDVS LGSTWLSDFP QAWAETGGMG LAVRQAPLII PLKATSTPVS IKQYPMSQEA RLGIKPHIQR LLD@GVLVPC QSPWNTPLLP |
| L5_40 | 1 | TLNIEDEHRL HETSKEPDVS LGSAWLSDFP QAWAETGGMG RAVRQAPLII PLKATSTPVS IKQYPMSQEA RLGIKPHIQR LLD@GILVPC QSPWNTPLLP |
| L5_41 | 1 | TLNIEDEHRL HETSKEPDVS LGSTWLSDFP QAWAETGGMG LAVRQAPLII PLKATSTPVA IKQYPMSQEA RLGIKPHIQR LLD@GILVPC QSPWNTPLLP |
| L5_42 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_43 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_44 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QPPWNTPLLP |
| L5_46 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_47 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_48 | 1 | TLNIEDEHRL HETSKEPDVS LGSTWLSDFP QAWAETGGMG LAVRQAPLII PLKATSTPVS IKQYPMSQEA RLGIKPRIQR LLD@GILVPC QSPWNTPLLP |
| L5_49 | 1 | TLNIEDEHRL HETSKEPDVS LGSTWLSDFP QAWAETGGMG LAVRQAPLV PLKATSTPVS IKQYPMSQEA RLGIKPHIQR LLD@GILVPC QSPWNTPLLP |
| L5_51 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_52 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_53 | 1 | TLNIEDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |
| L5_55 | 1 | TLNKDEHRL HETSKEPDVS LGSTWLSDFP QAWAETGGMG LAVRQAPLII PLKATSTPVS IKQYPMSQEA RLGIKPHIQR LLD@GILVPC QSPWNTPLLP |

```
L5_56   1   TLNIEDEPRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_57   1   TLNIEDEHRL HETSKEPDVS LGSTWLSDFP QAWAETGGMG LAVRQAPLV
PLKATSTPVS IKQYPMSQEA RLGIKPHIQR LLDQGILVPC QSPWNTPLLP
L5_58   1   TLNIEDEHRL HETSKEPDVS LGSTWLSDFP QAWAETGGMG LAVRQAPLII
PLKATSTPVS IKQYPLSQEA RLGIKPHIQR LLDQGILVPY QSPWNTPLLP
L5_59   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_60   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_61   1   TLNIEDEHRL HETSKEPDVS LGSTWLSDFP QAWAETGGMG LAVRQAPLII
PLKATSTPVS IKQCPMSQEA RLGIKPHIQR LLDQGILVPC QSPWNTPLLP
L5_62   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_63   1   TLNIEDEHRL HETSKEPDVS LGSTWLSDFP QAWAETGGMG LAVRQAPLV
PLKATSTPVS IKQYPMSQEA RLGIKPHIQR LLDQGILVPC QSPWNTPLLP
L5_64   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_65   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_66   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSLWNTPLLP
L5_68   1   TLNIEDEHRL HETSKEPDVS LGSTWLSDFP QAWAETGGVG LAVRQAPLV
PLKATSTPVS IKQYPMSQEA RLGIKPHIQR LLDQGILVPC RSPWNTPLLP
L5_69   1   TLNIEDEHRL HETTKEPDVS LGSTWLSDFP QAWAETGGMG LAVRQAPLI
PLKATSTPVS IKQMPMSQEA RLGIKPHIQR LLDQGILVPC QSPWNTPLLP
L5_71   1   TLNIEDEHRL HETSKEPDVS LGSTWLSDFP QAWAETGGMG LAVRQAPLII
PLKATSTPVS IKQMPMSQEA RLGIKPHIQR LLDQGILVPC QSPWNTSLLP
L5_72   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_73   1   TLNIEDEHRL HETSKEPDVS LGSTWLSDFP QAWAETGGMG LAVRQAPLII
PLKATSTPVS IKQYPMPQEA RLGIKPHIQR LLDQGILVPC QSPWNTPLLP
L5_75   1   TLNIEDEHRL YETSKEPDVS LGSTWLSDFP QAWAETGGMG LAVRQAPLII
PLKATSTPVS IKQYPMSQEA RLGIKPHIQR LLDQGILVPC QSPWNTPLLP
L5_76   1   TLNIEDEHRL HETSKEPDVS LGSTWLSDFP QAWAETGGMG LAVRQAPLII
PLKATSTPVS IKQYPLSQEA RLGIKPHIQR LLDQGILVPC QSPWNTPLLP
L5_78   1   TLNIEDEHRL RETSKEPDVS LGSTWLSDFP QAWAETGGMG LAVRQAPLII
PLKATSTPVS IKQYPMSQEA RLGIKPHIQR LLDQGILVPC QSPWNTPLLP
L5_79   1   TLNIEDEHRL HETSKEPDVS LGSTWLSDFP QAWAETGGMG LAVRQAPLII
PLKATSTPVS IKQYPMSQEA RLGTKPHIQR LLDQGILVPC QSPWNTPLLP
L5_80   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_81   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_82   1   TLNIEDEHRL HETSKEPDVS LGSTWPSDFP QAWAETGGMG LAVRQAPLII
PLKATSTPVS IKQYPMSQEA RLGIKPHIQR LLDQGILVPC QSPWNTPLLP
L5_84   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_85   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_87   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_88   1   TLNIEDEHRL HETSKEPDVS LGSTWLSDFP QAWAETGGMG LAVRQAPLII
PLKATSTPVS IKQYPMSQEV RLGIKPHIQR LLDQGILVPC QSPWNTPLLP
L5_90   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
```

```
L5_92   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_93   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_94   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_95   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_96   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_97   1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_99   1   TLNIEDEHRL HETSKEPDVS LGSTWLSDFP QAWAEIGGMG LAVRQAPLII PLKATSTPVS
IKQYPMSQEA RLGIKPHIQR LLDQGILVPC QSPWNTPLLP
L5_101  1   TLNIEDEHRL HETSKEPDVS LGSTWLSDFP QAWAETGGMG LAVRQAPLII
PLKATSTPVS IKQYSMSQEA RLGIKPHIQR LLDQGILVPC QSPWNTPLLP
L5_103  1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNMPLLP
L5_104  1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_106  1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_107  1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_111  1   TLNIEDEHRL HETSKEPDVS LGSTWLSDFP QAWAETGGMG LAVRQAPLII
PLKATSTPVS IKQYSMSQEA RLGIKPHIQR LLDQGILVPC QSPWNTPLLP
L5_112  1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_114  1   TLNIEDEHRL HETSKESDVS LGSTWLSDFP QAWAETGGMG LAVRQAPLII
PLKATSTPVS IKQYPMSQEA RLGIKPHIQR LLDQGILVPC QSPWNTPLLP
L5_115  1   TLNIEDEPRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_116  1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_117  1   TLNIEDEHRL HETPKEPDVS LGSTWLSDFP QAWAETGGMG LAVRQAPLII
PLKATSTPVS IKQYPMSQEA RLGIKPHIQR LLDQGILVPC QSPWSTPLLP
L5_118  1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
L5_120  1   TLNIEDEHRL HETSKEPDVS LGSTWLSDFP QAWAETGGMG LAVRQAPLII
PLKATSTPVS IKQYPMSQEA RLGIKPHIQR LLDQGILVPC QSPWNTPLLP
```

```
MLV     101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
1       101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
3       101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
5       101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPQ GFKNSPTLFD
7       101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
8       101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPQ GFKNSPTLFD
10      101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
11      101  VKKPGTNDYR PVQDLREVNK RVEDIHPTVP NPYNLLSGLP PSHQWYTMLD
LKDAFFCLRL HPTSQPLFAF EWRDPEMGIS GQLTWTRLPQ GFKNSPTLFD
12      101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
13      101  VKKPGTNDYR PVQDLREVNK RVEDIHPTVP NPYNLWSGLP PSHQWYTVLD
LKDAFFCLRL HPTSQPLFAF EWRDPEMGIS GQLTWTRLPQ GFKNSPTLFD
16      101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
17      101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
18      101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPQ GFKNSPTLFN
20      101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
21      101  VKKPGTNDYR PVQDLREVNK RVEDIHPTVP SPYNLLSGLP PSHQWYTVLD
LKDAFFCLRL HPTSQPLFAF EWRDPEMGTS GQLTWTRLPQ GFKNSPTLFD
23      101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
28      101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
30      101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_1    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_2    101  VKKPGTNDYR PVQDLREVNK RVEDIHPTVP NPYNLLSGLP PSHQWYTVLD
LKDAFFCLRL HPTSQPLFAF EWRDPEMGIS GQLAWTRLPQ GFKNSPTLFD
L5_3    101  VKKPGTNDYR PVQDLREVNK RVEDVHPTVP NPYNLLSRLP PSRQWYTVLD
LKDAFFCLRL HPTSQPLFAF EWRDPEMGIS GQLTWTRLPQ GFKNSPTLFD
L5_4    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_6    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_8    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_9    101  VKKPGTNDYR PVQDLREVNK RVEDIHPTVP NPYNPLSGLP PSHQWYTVLD
LKDAFFCLRL HPTSQSLFAF EWRDPEMGIS GQLTWTRLPQ GFKNSPTLFD
L5_11   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_13   101  VKKPGTNDYR PVQDLREVNK RVEDIHPTVS NPYNLLSGLP PSHQWYTVLD
LKDAFFCLKL HPTSQPLFAF EWRDPEMGIS GQLTWTRLPQ GFKNSPTLFA
L5_14   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPALFG
```

```
L5_15   101  VKKPGTNEYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_16   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_18   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_20   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFA
L5_21   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_23   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_24   101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPQ GFKNSPTLFD
L5_25   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_28   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_29   101  VKKPGTNDYR PVQDLREVNK RVEDIHPTVP NPYNLLSGLP PSHQWYTVLD
LKDAFFCLRL HPTSQPLFAF EWRGPEMGIS GQLTWTRLPQ GFKNSPTLFD
L5_30   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFA
L5_32   101  VKKPGTNDYR PVQDLREVNK RVEDIHPTVP NPYNPLSGPP PSHQWYTVLD
LKDAFFCLRL HPTSQPLFAF EWRDPEMGIS GQLTWTRLPQ GFKNSPTLFD
L5_35   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_37   101  VKKPGTNDYR PVQDLREVNK RVEDISPTVP NPYNLLSGLP PSHQWYTVFD
LKDAFFCLRL HPTSQPLFAF EWRDPEMGIS GQLTWTRLPQ GFKNSPTLFN
L5_39   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_40   101  VKKPGTNDYR PVQDLREVNK RVEDIHSTVP NPYNLLSGLP PSHQWYTVLD
FKDAFFCLRL HPTSQPLFAF EWRDPEMGIS GQLTWTRLPQ GFKNSPTLFD
L5_41   101  VKKPGTNDYR PVQDLREVNK RVEDIHPTVP NPYNLLSGPP PSHQWYTVLD
LKDAFFCLRL HPTSQPLSAF EWRDPEMGIS GQLTWTRLPQ GFKNSPTLYD
L5_42   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GLKNSPTLFD
L5_43   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_44   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_46   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_47   101  VKKPGTSDYR PVQDLREVNK RVEDIRPAVP NPYNLLSGLP PSHQWYTVLD
LKDAFFCLRL HPTSQPLFAF EWRDPEMGVS GQLTWTRLPQ GFKNSPTLFN
L5_48   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_49   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKSSPTLFD
L5_51   101  VKKPGTNDYG PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
```

```
L5_52   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_53   101  VKKPGTNDYR PVQDLREVNK RVEDIHPTVS NPYNLLSGPP PSHQWYTVLD
LKDAFFCLRL HPTSQPLFAF EWRDPEMGIS GQLTWTRLPQ GFKNSPTLFD
L5_55   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_56   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_57   101  VKKPGTNDYR PVQDLREVNK RVEDIHPTVP NPYNLLSGLP PSHQWYTVLD
LKDAFFCLRL HPTSQPLFAF EWKDPEMGIS GQLTWTRLPQ GFKNSPTLFD
L5_58   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_59   101  VKKPGTNDYR PVQDLREVNK RVEDIHPTVP NP  NLLSGLP PSHQWYTVLD
LKDAFFCLRL HPTSQPLFAF EWRDPEMGIS GQLTWTRLPQ GFKNSPTLFD
L5_60   101  VKKPGTNDYR PAQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_61   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_62   101  VKKPGTNDYR PVQDLREANK RVEDIHPTVP NPYNLLSGLP PSHQWYTVLD
LKDAFFCLRL HPTSQPLFAF EWRDPEMGIS GQLTWTRLPQ GFKNSPTLFD
L5_63   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKSSPTLFD
L5_64   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_65   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_66   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_68   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_69   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_71   101  VKKPGTNDYR PVQDLREVNK RVEDIHPTVP NPYNLLSGLP PSHQWYTVLD
LKDAFFCLRL HPTSQPLFAF EWRDPEMGIS GQLAWTRLPQ GFKNSPTLFD
L5_72   101  VKKPGTNDYR PVQDLREVNK RVEDIHPTVP NPYNLLSGPP PSHQWYTVLD
L  DAFFCLRL HPTSQPLFAF EWRDPEMGIS GQLTWTRLPQ GFKNSPTLFN
L5_73   101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPQ GFKNSPTLFD
L5_75   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_76   101  VKKPETNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_78   101  VKKPGTNDYR PVQDLREVNK RVEDIHPTVP NPYNLLSGLP PSHQWYTMLD
LKDAFFCLRL HPTSQPLFAF EWRDPEMGIS GQLTWTRLPQ GFKNSPTLFD
L5_79   101  VKKRGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_80   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_81   101  VKKPGTNDYR PVQDLREVNK RVEDIHPTVP NPYNLLSGLP PSHQWYTVLD
LKDAFFCLRL HPTSQSLFAF EWRDPEMGIS GQLTWTRLPQ GFKNSPTLLD
L5_82   101  VKKPGTNDYR PVQDLREVNK RVEDIHPTVS NPYNLLGGLP PSHQWYTVLD
LKDAFFCLRL HPTSQPLFAF EWRDPEMGIS GQLTWTRLPQ GFKNSPTLFD
L5_84   101  VKKPGTNDYR PVQDLREVNK RVEDIRPTVP NPYNLLSGPP PSHQWYTVLD
LKDAFFCLRL HPTSQPLFAF EWRDPEMGIS GQLTWTRLPQ GFKNSPTLFD
L5_85   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
```

```
L5_87    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_88    101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPQ GFKNSPTLFD
L5_90    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_92    101  VKKPGTNDYR PVQDLREVNK RVEDISPTVP NPYNLLSGLP PSHQWYTVLD
LKDAFFCLRL HPTSQPLFAF EWRDPEMGIS GQLTWTRLPQ GFKNSPTLFN
L5_93    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_94    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_95    101  VKKPGTNDYR PVQDLREVNK RVEGIHPTVP NPYNLLSGLP PSHQWYTVLD
LKDAFFCLRL HPTSQPLFAF EWRDPEMGIS GQLTWTGLPQ GFKNSPTLFD
L5_96    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_97    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_99    101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_101   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_103   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_104   101  VKKPGTNDYR PVQDLREVNK RVEDIHPTVP NSYNLLSGLP PSHQWYTVLD
LKDAFFCLRL HPTGQPLFAF EWRDPEMGIS GQLTWTRLPQ GFKNSPTLFD
L5_106   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_107   101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPQ GFKNSPTLFD
L5_111   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_112   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFN
L5_114   101  VKKPGTNEYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_115   101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPQ GFKNSPALFG
L5_116   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_117   101  VKKPGTNDYR PVQDLREVNK RVEDIHPTVP NPYNLLSGPP PSHQWYTVLD
LKDAFFCLRL HPTSQPLFAF EWRDPEMGIS GQLTWTRLPR GFKNSPTLFD
L5_118   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
L5_120   101  VKKPGTNDYR PVQDLREVNK RVEDIHPTVP NPYNLLSGLP PSHQWYTVLD
LKDAFFCLRL HPTSQPLFAF EWRDPEMGIS GQLTWTRLPQ GFKNSPTLFD
```

MLV    201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
1      201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
3      201  EALHRDLADF RIQHPDLILL RYVDDLLLAA TSELDCQQGT RALLQTLGNL GYRASAKKAQ ICQKQVKYLG YLLKEGQRWL TEARKETVMG QPTPKTPRQL
5      201  EALHRDLADF RIQHPDLILL QYVDDLLLAA TSELDCQQGT RALLQTLGNL GYRASAKKAQ ICQKQVKYLG YLLKEGQRWL TEDRKETVMG QPTPKTPRQL
7      201  EALRRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
8      201  EALHRDLADF RIQHPDLILL QYVDDLLLAA TSELDCQQGT RALLQTLGNL GYRASAKKAQ ICQKQVKYLG YLLKEGQRWL TEARKEAVMG QPTPKTPRQL
10     201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
11     201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
12     201  EALHRDLADF RIQHPDLILL QYVDDLLLAA TSELDCRQGT RALLQTLGNL GYRASAKKAQ ICQKQVKYLG YLLKEGQRWL TEARKETVMG QPTPKTPRQL
13     201  EALHRDPADF RIQHPDLILL QYVDDLLLAA TSELDCQQGT RALLQTLGNL GYRASAKKAQ ICQKQVKYLG YLLKEGQRWL TEARKETVMG QPTPKTPRQL
16     201  EALHRDLADF RIQHPDLILL QYVDDLLLAA TSELDCQQGT QALLQTLGNL GYRASAKKTQ ICQKQVKYLG YLLKEGQRWL TEARKETVMG QPTPKTPRQL
17     201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
18     201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
20     201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
21     201  EALRRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
23     201  EALHRDLADF RIQHPDLILL RYVDDLLLAA TSELDCQQGT RALLQTLGNL GYRASAKKAQ ICQKQVKYLG YLLKEGQRWL TEARKETVMG QPTPKTPRQL
28     201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
30     201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
L5_1   201  EALHRDLADF RIQHPDLILL QYVDDLLLAA TSELDCQQGT RALLQTLGDL GYRASAKKAQ ICQKQVKYLG YLLKEGQRWL TEARKETVMG QPTPKTPRQL
L5_2   201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
L5_3   201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
L5_4   201  EALHRDLVDF RIQHPDLILL QYVDGLLLAA TSELDCQQGT RALLQTLGNL GYRASAKKAQ ICQKQVKYLG YLLKEGQRWL TEARKETVMG QPTPKTPRQL
L5_6   201  EALHRDLADF RIQHPDLILL QYVDDLLLAA TSELDCQQGT RALLQTLGNL GYRASAKKAQ ICQKQVKYLG YLLKEGQRWL TEARKEAVMG QPTPKTPRQL
L5_8   201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
L5_9   201  EALHRDLADF RIQRPDLILL QCVDDLLLAA TSELDCQQGT RALLQTLGNL GYRASAKKAQ ICQKQVKYLG YLLKEGQRWL TEARKETVMG QPAPKTPRQL
L5_11  201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL
L5_13  201  EALHRDLADF RIQHPDLILL RYVDDLLLAA TSELDCQQGT RALLQTLGNL GYRASAKKAQ ICQKQVKYLG YLLKEGQRWL TEARKETVMG QPTPKTPRQL
L5_14  201  EALHRDLADF RIQHPDLILL QYVDDLLLAA TSELDCQQGT RALLQTLGNL GYRASAKKAQ ICQKQVKYLG YLLKEGQRWL TEARKETVMG QPTPKTPRQL

```
L5_15   201  EALHRDLADF RIQHPDLILL QYVDDLLLAA TSELDCQQGT RALLQTLGDL
GYRASAKKAQ ICQKQVKYLG YLLKEGQRWL TEARKETVMG QPTPKTPRQL
L5_16   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_18   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_20   201  EALHRDLADF RIQHPDLILL RYVDDLLLAA TSELDCQQGT RTLLQTLGNL
GYRASAKKAQ ICQKQVKYLG YLLKEGQRWL TEARKETVMG QPTPKTPRQL
L5_21   201  EALHRDLADF RIQHPDLILL QYVDDLLLAA TSKLDCQQGT RALLQTLGNL
GYRASAKKAQ ICQKQVKYLG YLLKEGQRWL TEARKETVMG QPTPKTPRQL
L5_23   201  EALHRDLADF RIQHPDLILL QYMDDLLLAA TSELDCQQGT RALLQTLGNL
GYRASAKKAQ ICQKQVKYLG YLLKEGQRWL TEARKETVMG QPTPKTPRQL
L5_24   201  EALHRDLADF RIQHPDLILL RYVDDLLLAA TSELDCQQGT RALLQTLGNL
GYRASAKKAQ ICQKQVKYLG YLLKEGQRWL TEARKETVMG QPTPKTPRQL
L5_25   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_28   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_29   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_30   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_32   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_35   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_37   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_39   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_40   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_41   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_42   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_43   201  EALHRDLADF RIQHPDLILL QYVDDLLLAA TSELDCRQGT RALLQTLGNL
GYRASAKKAQ ICQKQVKYLG YLLKEGQRWL TEARKETVMG QPTPKTPRQL
L5_44   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_46   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_47   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_48   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_49   201  EALRRDLADF RIQHPDLILL QYVDDLLLAA TSELDCQQGT RALLQTLGNL
GYRASAKKAQ ICQKQVKYLG YLLKEGQRWL TEARKEAVMG QPTPKTPRQL
L5_51   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
```

```
L5_52  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_53  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_55  201  EALHRDLADF RIQHPDLILL QYVDDLLLAA TSELDCQQGA RALLQTLGNL
GYRASAKKAQ ICQKQVKYLG YLLKEGQRWL TEARKETVMG QPTPKTPRQL
L5_56  201  EALHRDLADF WIQHPDLILL QYVDDLLLAA TSELDCQQGT RALLQTLGNL
GYRASAKKAQ ICQKQVKYLG YLLKEGQRWL TEARKETVMG QLTPKTPRQL
L5_57  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_58  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_59  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_60  201  EALHRDLADF RIQHPDLILL QYVDDLLLAA TSELDCQQGT RALLQTLGNL
GYRASAKKAQ ICQKQVKYLG YLLKEGQRWP TEARKETVMG QPTPKTPRQL
L5_61  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_62  201  EALRRDLADF RIQHPDLILL QYVDDLLLAA TSELDCQQGT RALLQTLGNL
GYRASAKKAQ ICQKQVKYLG-YLLKEGQRWL TGARKETVMG QPTPKTPRQL
L5_63  201  EALRRDLADF RIQHPDLILL QYVDDLLLAA TSELDCQQGT RALLQTLGNL
GYRASAKKAQ ICQKQVKYLG YLLKEGQRWL TEARKEAVMG QPTPKTPRQL
L5_64  201  EALHRDLADF RIQHPGLILL QYVDDLLLAA TSELDCQQGT RALLQTLGNL
GYRASAKKAQ ICQKQVKYLG YLLKEGQRWL TEARKETVMG QPTPKTPRQL
L5_65  201  EALHRDLADF RIQHPDLILL QYVDDLLLAA TSELDCQHGT RALLQTLGNL
GYRASAKKAQ ICQKQVKYLG YLLKEGQRWL TEARKETVMG QPTPKTPRQL
L5_66  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_68  201  EALRRDLADF RIQHPDLILL QYVDDLLLAA TSELDCQQGT RALLQTLGNL
GYRASAKKAQ ICQKQVKYLG YLLKEGQRWL TEARKEAVMG QPTPKTPRQL
L5_69  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_71  201  EALHRDLADF RIQHPDLILL QYVDDLLLAA TSELDCQQGT RALLQTLGNP
GYRASAKKAQ ICQKQVKYLG YLLKEGQRWL TEARKETVLG QPTPKTPRQL
L5_72  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_73  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_75  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_76  201  EALHRDLADF RIQHPDLILL QYVDDLLLAA TSELDCQQGT RALLQTLGNL
GYRASAKKAQ ICQKQVKYLG YLLKEGQRWL TEARKETVVG QPTPKTPRQL
L5_78  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_79  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_80  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_81  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_82  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_84  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_85  201  EALRRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
```

L5_87   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_88   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_90   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPGQL
L5_92   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_93   201  EALHRDLADF RIQHPGLILL QYVDDLLLAA TSELDCQQGT RALLQTLGNL
GYRASAKKAQ ICQKQVKYLG YLLKEGQRWL TEARKETVMG QPTPKTPRQL
L5_94   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_95   201  EALHRDLADF RIQHPDLILL QYVDDLLLAA TSELDCQQGT RALLQTLGNL
GYRASAKKAQ ICRKQVKYLG YLLKEGQRWL TEARKETVMG QPTPKTPRQL
L5_96   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_97   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_99   201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_101  201  EALRRDLADF RIQHPDLILL QYVDDLLLAA TSELDCQQGT RALLQTLGNL
GYRASAKKAQ ICQKQVKYLG YLLKEGQRWL TEDRKETVMG QPTPKTPRQL
L5_103  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_104  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_106  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_107  201  EALHRDLADF RIQHPDLILL QYVDDLLLAA TSKLDCQQGT RALLQTLGNL
GYRASAKKAQ ICQKQVKYLG YLLKEGQRWL TEARKETVMG QPTPETPRQL
L5_111  201  EALHRDLADF RIQHPDLILL QYVDDLLLAA TSKLDCQQGT RALLQTLGNL
GYRASAKKAQ ICQKQVKYLG YLLKEGQRWL TEARKETVMG QPTPKTPRQL
L5_112  201  EALHRDLADF RIQHPDLILL QYVDDLLLAA TSELDCRQGT RALLQTLGNL
GYRASAKKAQ ICQKQVKYLG YLLKEGQRWL TEARKETVMG QPTPKTPRQL
L5_114  201  EALHRDLADF RIQHPDLILL QYVDDLLLAA TSELDCQQGT RALLQTLGDL
GYRASAKKAQ ICQKQVKYLG YLLKEGQRWL TEARKETVMG QPTPKTPRQL
L5_115  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_116  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_117  201  EALHRDLADF RIQHPDLILL QYVDDLLLAA TSELDCQQGT RALLQTLGNL
GYRASAKKAQ ICQKQVKYLG YLLKEGQRWL TEARKETVMG QPTPKTPRQL
L5_118  201  EALHRDLADF RIQHPDLILL RYVDDLLLAA TSELDCQQGT RALLQTLGNL
GYRASAKKAQ ICQKQVKYLG YLLKEGQRWL TETRKEAVMG QPTPKTPRQL
L5_120  201  EALHRDLADF RIQHPDLILL QYVDDLLLAA TSELDCQQGT RALLQTLGNL
GHRASAKKAQ ICQKQVKYLG YLLKEGQRWL TEARKETVMG QPTPKTPRQL

```
MLV    301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
1      301  REFLGTAGEC RLWIPGFAEM AAPLYPLTKT GTLFNWGPDQ QKAYQEIKQA LLTAPALGLP
DLTKPFELFV DEKQGYAKGV LTQKLGPWRR PVAYLSKKLD
3      301  REFLGTAGEC RLWIPGFAEM AAPLYPLTKT GTLFNWGPDQ QKAYQEIKQA LLTAPALGLP
DLTKPFELFV DEKQGYAKGV LTQKLGPWRR PVAYLSKKLD
5      301  REFLGTAGEC RLWIPGFAEM AAPLYPLTKT GTLFNWGPDQ QKAYQEIKQA LLTAPALVLP
DLTKPFELFV DEKQGYAKGV LTQKLGPWRR PVAYLSKKLD
7      301  REFLGTAGEC RLWIPGFAEM AAPLYPLTKT GTLFNWGPDQ QKAYQEIKQA LLTAPALGLP
DLTKPFELFV DEKQGYAKGV LTQKLGPWRR PVAYLSKKLD
8      301  REFLGTAGEC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
10     301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
11     301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRW PVAYLSKKLD
12     301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
13     301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
16     301  REFLGTAGEC HLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
17     301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
18     301  REFLGTAGEC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
20     301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
21     301  REFLGTAGEC RLWIPGFAEM AALLYPLTKT GTLFNWGPDQ QKAYQEIKQA
LLAAPALGLP DLTKPFELFV DEKQGYAKGV LTQKLGPWRR PVAYLSKKLD
23     301  REFLGTAGEC RLWIPGFAEM AAPLYPLTKT GILFNWGPDQ QKAYQEIKQA LLTAPALGLP
DLTKPFELFV DEKQGYAKGV LTQKLGPWRR PVAYLSKKLD
28     301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
30     301  REFLGMAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_1   301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_2   301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR LVAYLSKKLD
L5_3   301  REFLGTAGEC RLWIPGFAEM AAPLYPLTKT GTLFNWGPDQ QKAYQEIKQA
LLTAPALGLP DLTKPFELFV DEKQGYAKGA LTQKLGPWRR PVAYLSKKLD
L5_4   301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_6   301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_8   301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_9   301  REFLGTAGEC RLWIPGFAEM AAPLYPLTKT GTLFNWGPDQ QKAHQEIKQA
LLTAPALGLP DLTKPFELFV DEKQGYAKGV LTQKLGPWRR PVAYLSKKLD
L5_11  301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_13  301  REFLGTAGEC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_14  301  REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
```

```
L5_15   301  REFLGTVGFC RLWIPGFAEM AAPLYPLTKT GTLFNWGPDQ QKAHQEIKQA
LLTAPALGLP DLTKPFELFV DEKQGYAKGV LTQKLGPWRR PVAYLSKKLD
L5_16   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_18   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_20   301  REFLGTAGFC RLWIPGFAEM AAPLYPLTKT ETLFNWGPDQ QKAYQEIKQA
LLTAPALGLP DLTKPFELFV DEKQGYAKGV LTQKLGPWRR PVAYLSKKLD
L5_21   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_23   301  REFLGTAGFC RLWIPGFAEM AAPLYPLTKT GTLFNWGPDQ QKAYQEIKQA
LLTAPALGLP DLTKPFELFV DEKQGYAKGV LTQKLGPRRW PVAYLSKKLD
L5_24   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_25   301  RKFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_28   301  REFLGAAGSC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_29   301  REFLGTAGFC RPWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_30   301  REFLGTAGFC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_32   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_35   301  REFLGTAGFC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_37   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_39   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_40   301  REFLGTAGFC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_41   301  REFLGTAGFC RLWIPGFAEM AAPLYPLTKT GTLFNWGPDQ QKAYQDIKQA
LLTAPALGLP DLTKPFELFV DEKQGYAKGV LTQKLGPWRR PVAYLSKKLD
L5_42   301  REFLGTAGFC RLWIPGFAEM AAPLYPLTKT GTPFNWGPDQ QKAYQEIKQA
LLTAPALGLP DLTKPFELFV DEKQGYAKGV LTQKLGPWRR PVAYLSKKLD
L5_43   301  REFLGTAGFC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_44   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_46   301  REFLGTAGFC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_47   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_48   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_49   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_51   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
```

```
L5_52   301  REFLGTAGFC RLWIPGFAEM AAPLYPLTKP GTLFNWGPDQ QKAYQEIKQA
LLTAPALGLP DLTKPFELFV DEKRGYAKGV LTQKLGPWRR PVAYLSKKLD
L5_53   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_55   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_56   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_57   301  RKFLGTAGFC RLWIPGFAEM AAPLYPLTKT GTLFNWGPDQ QKAYQEIKQA
LLTAPALGLP DLTKPFELFV DEKQGYAKGV LTQKLGPWRR PAAYLSKKLD
L5_58   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_59   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_60   301  REFLGTAGFC RLWIPGFAEM ATPLYPLTKT GTLFNWGPDQ QKAYQEIKQA
LLTAPALGLP DLTKPFELFV DEKQGYAKSV LTQKLGPWRR PVAYLSKKLD
L5_61   301  REFLGTAGFC RLWIPGFAEM AAPLYPLTKT GTLFNWGPDQ QKAYQEIKQA
VLTAPALGLP DLTKPFELFV DEKQGYAKGV LTQKLGPWRR PVAYLSKKLD
L5_62   301  REFLGTAGFC RLWIPGFAEM AAPLYPLTKT GTLFNWGPDQ QKAYQDIKQA
LLTAPALGLP DLTKPFELFV DEKQGYAKGV LTQKLGPWRR PVAYLSKKLD
L5_63   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_64   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_65   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_66   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_68   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_69   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_71   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_72   301  REFLGTAGFC RLWIPGFAEM AAPLYPLTKP GTLFNWGPDQ QKAYQEIKQA
LLTAPALGLP DLTKPFELFV DEKQGYAKGV LTQKLGPWRR PVTYLSKKLD
L5_73   301  REFLGTVGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_75   301  REFLGTAGFC RLWIPGFAEM AAPLHPLTKT GTQFNWGPDQ QKAYQEIKQA
LLTAPALGLP DLTKPFELFV DEKQGYAKGV LTQKLGPWRR PVAYLSKKLD
L5_76   301  REFLGTAGFC RLWTPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_78   301  REFLGTAGFC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_79   301  REFLGTAGFC RLWIPGFAEM AAPLHPLTKT GTQFNWGPDQ QKAYQEIKQA
LLTAPALGLP DLTKPFELFV DEKQGYAKGV LTQKLGPWRR PVAYLSKKLD
L5_80   301  REFLGTAGFC RLWIPGFAEM AAPLYSLTKT GTLFNWGPDQ QKAYQEIKQA
LLTAPALGLP DLTKPFELFV DEKQGYAKGV LTQKLGPWRR PVAYLSKKLD
L5_81   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_82   301  REFLGTAGFC RLWIPGFAEM AAPLYPLTKT GTLFNWGPDQ QKTYQEIKQA
LLTAPGLGLP DLTKPFELFV DEKQGYAKGV LTQKLGPWRR PVAYLSKKLD
L5_84   301  REFLGTAGFC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_85   301  REFLGTAGFC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
```

L5_87   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_88   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_90   301   REFLGTAGEC RLWIPGFAEM AAPLYPLTKP GTLFNWGPDQ QKAYQEIKQA
LLTAPALGLP DLTKPFELFV DEKRGYAKGV LTQKLGPWRR PVAYLSKKLD
L5_92   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_93   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_94   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_95   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_96   301   REFLGTAGEC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_97   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_99   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_101   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR SVAYLSKKLD
L5_103   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_104   301   REFLGTAGEC RLWIPGFAEM AAPLYPLTKT GTLFNWGPDQ QKAYQEIKQA
LLTAPALGLP DLTKPFELFV DEKQGYAKGV LTQKLGPRRR PVAYLSKKLD
L5_106   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_107   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_111   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_112   301   REFLGTAGEC RLWIPGFAEM AAPLYPLTKP GTLFNWGPDQ QKAYQEIKQA
LLTAPALGLP DLTKPFELFV DEKQGYAKGV LTQKLGPWRR PVAYLSKKLD
L5_114   301   REFLGTVGEC RLWIPGFAEM AAPLYPLTKT GTLFNWGPDQ QKAHQEIKQA
LLTAPALGLP DLTKPFELFV DEKQGYAKGV LTQKLGPWRR PVAYLSKKLD
L5_115   301   REFLGTAGEC RLWIPGFAEM AAPLYPLTKT GTLFNWGPDQ QKAYQEIKQA
LLTAPALWLP DLTKPFELFV DEKQGYAKGV LTQKLGPWRR PVAYLSKKLD
L5_116   301   REFLGTAGEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD
L5_117   301   REFLGTAGEC RLWIPGFAEM AAPLYPLTKT GTQFNWGPGQ QKAYQEIKQA
LLTAPALGLP DLTKPFELFV DEKQGYAKGA LTPKLGPWRR PVAYLSKKLD
L5_118   301   REFLGTAGEC RLWIPGFAEM AAPLYPLTKT GTLFNWGPDQ QKAYQEIKQA
LLTAPALGLP DLTKPFELIV DEKQGCAKGV LTQKLGPWRR PVAYLSKKLD
L5_120   301   REFLGTASEC RLWIPGFAEM AAPLYPLTKT GTLFNWGPDQ QKAYQEIKQA
LLTAPALGLP DLTKPFELFV DEKQGYAKGV LTQKLGPWRR PVAYLSKKLD

```
MLV    401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
1      401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
3      401  PVAAGWPPCL RMVAAIAVLT KDAGKLT@GQ PLVI@APHAV EALVKQPPDR
WLS@ARMTHY QALLLDTDRV QFGPVVALNP ATLLPLPEEG LQHNCLDILA
5      401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
7      401  PVAAGWPPCL RMVAAIAVLT KDAGKLTMGQ PL@I@APHAV EALVKQPPDR
WLS@ARMTHY QALLLDTDRV QFGPVVALNP ATLLPLPEEG LQHNCLDILA
8      401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
10     401  PVAAGWPPCL RMVAAIAVLT KDAGKLTMGQ PLVI@APHAV EALVKQPPDR
WLS@ARMTHY QALLLDTDRV QFGPVVALNP @TLLPLPEEG LQHNCLDILA
11     401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
12     401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
13     401  PVAAGWPPCL RMVAAIAVLT KDAGKLT@GQ PLVI@APHAV EALVKQPPDR
WLS@ARMTHY QALLLDTDRV QFGPVVALNP ATLLPLPEEG LQHNCLDILA
16     401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
17     401  PVAAGWPP@L RMVAAIAVLT KDAGKLTMGQ PLVI@APHAV EALVKQPPDR
WLS@ARMTHY QALLLDTDR@ QFGPVVALNP ATLLPLPEEG LQHNCLDILA
18     401  PVAAGWPPCL RMVAAIAVLT KDAGKLTMGQ PLVI@APHAV EALVKQPPDR
WLS@ARMTHY QALLLDTDRV QFGPVVAL@P ATLLPLPEEG LQHNCLDILA
20     401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
21     401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
23     401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
28     401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
30     401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
L5_1   401  PVAAGWPP@L RMVAAIAVLT KDAGKLTMGQ PLVI@APHAV EALVKQPPDR
WLS@ARMTHY QALLLDTDR@ QFGPVVALNP ATLLPLPEEG LQHNCLDILA
L5_2   401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
L5_3   401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
L5_4   401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
L5_6   401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
L5_8   401  PVAAGWPPCL RMVAAIAVLT KDAGKLTMGQ PLVI@APHAV EALVKQPPDR
WLS@ARMTHY QALLLDTDRV QFGP@VALNP ATLLPLPEEG LQHNCLDILA
L5_9   401  PVAAGW@PCL RMVA@IAVLT KDAGKLTMGQ PLVI@@PHAV EAL@KQ@PDR
WLS@ARMTHY QALLLDTDRV QFGPVVALNP ATLLPLPEEG LQHNCLDILA
L5_11  401  PVAAGWPPCL RMVAAIAVLT KDAGKLTMGQ PLVI@APHAV EALVKQPPDR
WLS@ARMTHY QALLLDTDRV QFGPVVALNP ATLLPLPEEG LQHNCLDILA
L5_13  401  PVAAGWPPCL RMVAAIAVLT KDAGKLTMGQ PLVI@APHAV EALVKQPP@R
WLS@ARMTHY QALLLDTDRV QFGPVVALNP ATLLPLPEEG LQHNCLDILA
L5_14  401  PVAAGWPPCL RMVAAIAVLT KDAGKLTMGQ PL@I@APHAV EALVKQPPDR
WLS@ARMTHY QALLLDTDRV QFGPVVALNP ATLLPLPEEG LQHNCLDILA
```

```
L5_15   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_16   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_18   401  PVAAGWPPCL RMVAAIAVLT KDAGKLTMGQ PLVILAPHAV EALVKQPPDR
WLSNARITHY QILLLDTDRV QFGPVVALNP ATLLPLPEEG LQHNCLDILA
L5_20   401  PVAAGWPPCL RMVAAIAVLT KDAGKLTLGQ PLVILAPHAV EALVKQPPDR
WLSNARMTHY QALLLDTDRV QFGPVVALNP ATLLPLPEEG LQHNCLDILA
L5_21   401  PVAAGWSPCL RMVAAIAVLT KDAGKLTMGQ PLVILAPHAV EALVKQPPDR
WLSNARMTHY QALLLDTDRV QFGPVVAPNP ATLLPLPEEG LQHNCLDILA
L5_23   401  PVAAGWPPCL RMVAAIAVLT KDAGKLTMGQ PLVIPAPHAV EALVKQPPDR
WLSNARMTHY QALLLDTDRV QFGPVVALNP ATLLPLPEEG LQHNCLDILA
L5_24   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_25   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_28   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_29   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_30   401  PVAAGWPPCL RMVAAIAVLT KDAGKLTMGQ PLVILAPHAV EALVKQPPGR
WLSNARMTHY QALLLDTDRV QFGPVVALDP ATLLPLPEEG LQHNCLDILA
L5_32   401  PVAAGWPPCL RMVAAIAVLT KDAGKLTMGQ QLVILAPHAV EALVKQPPDR
WLSNARMTHY QALLLDTDRV QFGPVVALNP ATLLPLPEEG LQHNCLDILA
L5_35   401  PVAAGWPPCL RMVAAIAVLT KDAGKLTMGQ PLVILAPHAV EALVKQPPDR
WLSNARMTHY QALLLDTDRV QFGPVVALDP ATLLPLPEEG LQHNCLDILA
L5_37   401  PVAAGWPPCL RMVAAIAVLT KDAGKLTMGQ PLVILAPHAV EALVKQPPDR
WLSKARMTHY QALLLDTDRV QFGPVVALNP ATLLPLPEEG LQHNCLDILA
L5_39   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_40   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_41   401  PVAAGWPPCL RMVAAIAVLT KDAGKLTMGQ PLVILAPHAV EALVKQPPDH
WLSNARMTHY QALLLDTDRV QFGPVVALNP ATLLPLPEEG LQHNCLDILA
L5_42   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_43   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_44   401  PVAAGWPPCL RMVAAIAVLT KDAGKLTMGR PLVILAPHAV EALVKQPPDR
WLSNARMTHY QALLLDTDRV QFGPVVALDP ATLLPLPEEG LQHNCLDILA
L5_46   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_47   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_48   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_49   401  PVAAGWPPCL RMVAAIAVLT KDAGKLTMGQ PLVILAPHAV EALVKQPPDR
WLSNARMTHY QALLLDTDRV QFGPVVALNP ATLLPLPEEG LQHNCLDILA
L5_51   401  PVAAGWPPCL RMVAAIAVLT KDAGKLTMGQ QLVILAPHAV EALVKQPPDR
WLSNARMTHY QALLLDTDRV QFGPVVALNP ATLLPLPEEG LQHNCLDILA
```

```
L5_52    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_53    401  PVAAGWPPCL RMVAAIVVLT KDAGKLTMGQ PLVILAPHAV EALVKQPPDR
         WLSNARMTHY QALLLDTDRV QFGPVVALNP ATLLPLPEEG LQHNCLDILA
L5_55    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_56    401  PVAAGWPPCL RMVAAIAVLT KDAGKLTMGQ PLVILAPHAV EALVKQPPDR
         WLSNARMTHY QALLLDTDRV QFGPVVALNP ATLLPPPEEG LQHNCLDILA
L5_57    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_58    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_59    401  PVAAGWPPCL RMVAAIAVLT KDAGKLTMGQ PLVILAPHAV EALVKQPPDH
         WLSNARMTHY QALLLDTDRV QFGPVVALNP ATLLPLPEEG LQHNCLDILA
L5_60    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_61    401  PVAAGWPPCL RMVAAIAVLT KDAGKLTMGQ PLVILAPHAV EALVKQPPAR
         WLSNARMTHY QALLLDTDRV QFGPVVALNP ATLLPLPEEG LQHNCLDILA
L5_62    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_63    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_64    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_65    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_66    401  PVAAGWPPCL RMVAAIAVLT KDAGKLTMGQ PLVILAPHAV EALVKQPPDR
         WLSNARRTHY QALLLDTDRV QFGPVVALNP ATLLPLPEEG LQHNCLDILA
L5_68    401  PVAAGWPPCL RMVAAIAVLT KDAGKLTMGQ PLVILAPHAV EALVKQPPDR
         WLSKARMTHY QALLLDTDRV QFGPVVALNP ATLLPLPEEG LQHNCLDILA
L5_69    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_71    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLGILA
L5_72    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_73    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_75    401  PVAAGWPPCL RMVAAIAVLT KDAGKLTMGR PLVILAPHAV EALVKQPPDR
         WLSNARMTHY QALLLDTDRV QFGPVVALNP ATLLPLPEEG LQHNCLDILA
L5_76    401  PVAAGWPPCL RMVAAIAVLT KDAGKLTMGQ PLVILTPHAV EALVKQPPDR
         WLSNARMTHY QALLLDTDRV QFGPVVALNP ATLLPLPEEG PQHNCLDILA
L5_78    401  PVAAGWPPCL RMVAAIAVLT KDAGKLTMGQ PLVILAPHAV EALVKQPPDR
         WLSNARMTRY QALLLDTDRV QFGPVVALNP ATLLPLPEEG LQHNCLDILA
L5_79    401  PVAAGWPPCL RMVAAIAVLT KDAGKLTMGR PLVILAPHAV EALVKQPPDR
         WLSNARMTHY QALLLDTDRV QFGPVVALNP ATLLPLPEEG LQHNCLDILA
L5_80    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_81    401  PVAAGWPPCL RMVAAIAVLT KDAGKLTMGQ PLVILAPHAV EALVKRPPDR
         WLSNARMTHY QALLLDTARV QFGPVVALNP ATLLPLPEEG LQHNCLDILA
L5_82    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
L5_84    401  PVAAGWPPCL RMVAAIVVLT KDAGKLTMGQ PLVILAPHAV EALVKQPPDR
         WLSNARMTHY QALLLDTDRV QFGPVVALNP ATLLPLPEEG PQHNCLDILA
L5_85    401  PVAAGWPPCL RMVAAIAVLT KDAGKLTMGQ PLVILAPHAV EALVKQPPDR
         WLSNARMTHY QALLLDTDRV QFGPVVALNP ATLLPLPEEG LQHNCLDILA
```

```
L5_87    401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_88    401  PVAAGWPPCL RMVAAIAVLT KDAGKLTMGQ PLVIEAPHAV EALVKQPPDR
WLSNARMTHY QALLLDTDRV QFGPVVALDP ATLLPLPEEG LQHNCLDILA
L5_90    401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_92    401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_93    401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_94    401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHDCLDILA
L5_95    401  PVAAGWPPCL RMVAAIAVLT KDAGKLTMGQ PLVIEAPHAV EALVKQPPDR
WLSKARMTHY QALLLDTDRV QFGPVVALNP ATLLPLPEEG LQHKCLDILA
L5_96    401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_97    401  PVAAGWPPCL RMVAAIAVLT KDAGKLTMGQ PLVIEAPHAV EALVKQPPDR
WLSNARMTHY QALLLDTDRV QFGPVVALNP ATLPPLPEEG LQHNCLDVLA
L5_99    401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_101   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_103   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_104   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_106   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_107   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_111   401  PVAAGWSPCL RMVAAIAVLT KDAGKLTMGQ PLVIEAPHAV EALVKQPPDR
WLSNARMTHY QALLLDTDRV QFGPVVAPNP ATLLPLPEEG LQHNCLDILA
L5_112   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_114   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_115   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_116   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_117   401  PVAAGWPPCL RMVAAIAVLT KDAGKLTMGQ PLVIEAPHAV EALVKQPPDR
WLSNARMTHY QALLLDTDRV QFGPVVALNP ATLLPLPEEG LQHNCLDILA
L5_118   401  PVAAGWPPCL RMVAAIAVLT KDAGKLTMGQ PLVTLAPHAV EALVKQPPDR
WLSNARMTHY QALLLDTDRV QFGPVVALNP ATLLPLPEEG LQHNCLDILA
L5_120   401  PVAAGWPPCL RMVAAIAVLT KDAGKLTMGQ PLVIEAPHAV GALVKQPPDR
WLSNARMTHY QALLLDTDRV QFGPVVALNP ATLLPLPEEG LQHNCLDILA
```

```
MLV   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
1     501  EAHGTRPDLT DQPLPDADHT WYTAGSSLLQ EGQRKAGAAV TTETEVIWAK
ALPAGTSAQR AELIALTQAL KMAEGKKLNV YTDSRYAFAT AHIRGEIYRR
3     501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
5     501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
7     501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
8     501  EAHGTRPDLT DQPFPDADHT WYTDGSSLLQ EGQRKAGAAV TTETEVIWAK
ALPAGTSAQR AELIALTQAL KMAEGKKLNV YTDSRYAFAT AHIHGEIYRR
10    501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
11    501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
12    501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
13    501  EAHGTRPDLT DQPLPDADHT WYTDGSSLLQ EGQRKAGAAV TTETEVIWAK
ALPAGTSAQW AELIALTQAL KMAEGKKLNV YTDSRYAFAT AHIHGEIYRR
16    501  EAHGTRPDLT DQPLPDADHT WYTDGSSLLQ EGQRKAGAAV TTEIEVIWAK
ALPAGTSAQR AELIALTQAL KMAEGKKLNV YTDSRYAFAT AHIHGEIYRR
17    501  EVHGTRPDLT DQPLPDADHT WYTDGSSLLQ EGQRKAGAAV TTETEVIWAK
ALPAGTSAQR AELIALTQAL KMAEGKKLNV YTNSRYAFAT AHIHGEIYRR
18    501  EAHGTRPDLT DQPLPDADHT WYTDGSSLLQ EGQRKAGAAV TTETEVIWAK
ALPAGTSAQR AELIALTQAL KMAEGKQLNV YTGSRYAFAT AHIHGEIYRR
20    501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
21    501  EAHGTRPDLT DQPLPDADHT WYTDGSSLLQ EGQRKAGAAV TTETEVIWAK
ALPAGTSAQR AELIALTQAL KMAEGKKLNV YTASRYAFAT AHIHGEIYRR
23    501  EAHGTRPDLT DQPLPDADHT WYTAGSSLLQ EGQRKAGAAV TTETEVIWAK
ALPAGTSAQR AELIALTQAL KMAEGKKLNV YTDSRYAFAT AHIHGEIYRR
28    501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
30    501  EAHGTRPDLT DQPLPDADHT WYTNGSSLLQ EGQRKAGAAV TTETEVIWAK
ALPAGTSAQR AELIALTQAL KMAEGKKLNV YTGSRYAFAT AHIHGEIYRR
L5_1  501  EVHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_2  501  EAHGTRPDLT DQPLPDADHT WYTDGSSLLQ EGQRKAGAAV TTKTEVIWAK
ALPAGTSAQR AELIALTQAL KMAEGKKLNV YTDSRYAFAT AHIHGEIYRR
L5_3  501  EAHGTRPDLT DQPLPDADHT WYTDGSSLLQ EGQRKAGAAV TTETEVIWAK
APPAGTSAQR AELIALTQAL KMAEGKKLNV YTDSRYAFAT AHIHGEIYRR
L5_4  501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_6  501  EAHGTRPDLT DQPLPDADHT WYTAGSSLLQ EGQRKAGAAV TTETEVIWAK
ALPAGTSAQR AELIALTQAL KMAEGKKLNV YTDSRYAFAT AHIRGEIYRR
L5_8  501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_9  501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_11 501  EAHGTRPDLT DQPLPDADHT WYTDGSSLLQ EGQRKAGAAV TTETEVIWAK
ALPAGTSAQR AELIALTQAL KMAEGRKLNV YTDSRYAFAT AHIHGEIYRR
L5_13 501  EAHGTRPDLT DQPLPDADHT WYTGGSSLLQ EGQRKAGAAV TTETEVIWAK
ALPAGTSAQR AELIALTQAL KMAEGKKLNV YTESRYAFAT AHIHGEIYRR
L5_14 501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
```

```
L5_15   501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_16   501  EAHGTRPDLT DQPLPDADHT WYTDGSSLLQ EGQRKAGAAV TTETEVIWAK
ALPAGTSAQR AELIALTQAL KMAEGKKLNV YTGSRYAFAT AHIHGEIYRK
L5_18   501  EAHRTRPDLT DQPLPDADHT WYTDGSSLLQ EGQRKAGAAV TTETEVIWAK
ALPAGTSARR AELIALTQAL KMAEGKKLNV YTDSRYAFAT AHIHGEIYRR
L5_20   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_21   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_23   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_24   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_25   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_28   501  EAHGTRPDLT DQPLPDADHT WYTAGSSLLQ EGQRKAGAAV TTETEVIWAK
ALPAGTSAQR AELIALTQAL KMAEGKKLNV YTDSRYAFAT AHIRGEIYRR
L5_29   501  EVHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_30   501  EAHGTRPDLT DQPLPDADHT WYTDGSSLLQ EGQRKAGAAV TTETEVIWAK
ALPAGTSAQR AELIALTQAL KMAEGKKLNV YTNSRYAFAT AHIHGEIYRR
L5_32   501  EAHGTRPDLT DQPLPDADHT WYTDGSSLLQ EGQRKAGAAV TTETEVIWAK
ALPAGTSAQR AELIALTQAL KMAEGKKLNV YTGSRYAFAT AHIHGEIYRR
L5_35   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_37   501  EAHGTRPDLT DQPLPDADHT WYTDGSSLLQ EGQRKAGAAV TTETEVIWAK
ALPAGTSAQR AELIALTQAL KMAEGKKLNV YTNSRYAFAT AHIHGEIYRR
L5_39   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_40   501  EARGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_41   501  EAHGTRPDLT DQPLPDADHT WYTGGSSLLQ EGQRKAGAAV TTETEVIWAK
ALPAGTSAQR AELIALTQAL KMAEGKKLNV YTGSRYAFAT AHIHGEIYRR
L5_42   501  EAHGTRPDLT DQPLPDADHT WYTDGSSLLQ EGQRKAGAAV TTETEVIWAK
ALPAGASAQR AELIALTQAL KMAEGKKLNV YTDSRYAFAT AHIHGEIYRR
L5_43   501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_44   501  EAHGTRPDLT DQPLPDADHT WYTDGSSLLQ EGQRKAGAAV TTETEVIWAK
ALPAGTSAQR AELIALTQAL KMAEGKKLNV YTNSRYAFAT AHIHGEIYRR
L5_46   501  EAHGTRPDLT DQPLPDADHT WYTDGSSLLQ EGQRKAGAAV TTETEVIWAK
ALPAGTSAQR AELIALTQAL KMAEGKKLNV YTNSRYAFAT AHIHGEIYRR
L5_47   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_48   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_49   501  EAHGTRPDLT DQPLPDADHT WYTAGSSLLQ EGQRKAGAAV TTETEVIWAK
ALPAGTSAQR AELIALTQAL KMAEGKKLNV YTDSRYAFAT AHIHGEIYRR
L5_51   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
```

```
L5_52   501  EAHGTRPDLT DQPLPDADHT WYTDGSSLLQ EGQRKAGAAV TTETEVIWAK
ALPAGTSAQR AELIALTQAL KMAEGKKLNV YTNSRYAFAT AHIHGEIYRR
L5_53   501  EAHGTRPDLT DQPLPDADHT WYTGGSSLLQ EGQRKAGAAV TTETEVIWAK
ALPAGTSAQR AELIALTQAL KMAEGKKLNV YTNSRYAFAT AHIHGEIYRR
L5_55   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_56   501  EAHGTRPDLT DQPLPDADHT WYTAGSSLLQ EGQRKAGAAV TTETEVIWAK
ALPAGTSAQR AELIALTQAL KMAEGKKLNV YTDSRYAFAT AHIRGEIYRR
L5_57   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_58   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_59   501  EARGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_60   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_61   501  EAHGTRPDLT DQPLPDADHT WYTDGSSLLH EGQRKAGAAV TTETEVIWAK
ALPAGTSAQR AELIALTQAL KMAEGKKLNV YTDSRYAFAT AHIHGEIYRR
L5_62   501  EAHGTRPDLT DQPLPDADHT WYTAGSSLLQ EGQRKAGAAV TTETEVIWAK
ALPAGTSAQR AELIALTQAL KMAEGKKLNV YTDSRYAFAT AHIHGEIYRR
L5_63   501  EAHGTRPDLT DQPLPDADHT WYTAGSSLLQ EGQRKAGAAV TTETEVIWAK
ALPAGTSAQR AELIALTQAL KMAEGKKLNV YTDSRYAFAT AHIHGEIYRR
L5_64   501  EAHGTRPDLT DQPLPDADHT WYTAGSSLLQ EGQRKAGAAV TTETGVIWAK
ALPAGTSAQR AELIALTQAL KMAEGKKLNV YTDSRYAFAT AHIHGEIYRR
L5_65   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_66   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_68   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_69   501  EAHGTRPDLT DQPLPDADHT WYTDGSSLLQ EGQRKAGTAV TTETEVIWAK
ALPAGTSAQR AELIALTQAL KMAEGKKLNV YTDSRYAFAT AHIHGEIYRR
L5_71   501  EAHGTRPDLT DQPLPDADHT WYTDGSSLLQ EGQRKAGAAV TTETEVIWAK
TLPAGTSAQR AKLIALTQAL KMAEGKKLNV YTDSRYAFAT AHIHGEIYRR
L5_72   501  EAHGTRPDLT DQPLPDADHT WYTDGSSLLQ EGQRKAGAAV TTETEVIWAK
ALPAGTSAQR AELIALTQAL KLAEGKKLNV YTDSRYAFAT AHQGEIYRR
L5_73   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_75   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGETYRR
L5_76   501  EAHGTRPDLT DQPLPDADHT WYTDGSSLLQ EGQRKAGAAV TTETEVIWAK
ALPAGTSAQR AELIALTQAL KMTEGKKLNV YTNSRYAFAT AHIHGEIYRR
L5_78   501  EVHGTRPDLT DQPLPDADHT WYTBGSSLLQ EGQRKAGAAV TTETEVIWAK
ALPAGTSAQR AELIALTQAL KMAEGKKLNV YTDSRYAFAT AHIHGEIYRR
L5_79   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGETYRR
L5_80   501  EAHGTRPDLT DQPLPDADHT WYTDGSSLLQ EGQRKAGAAV TTETEVIWAK
ALPAGTSAQR AELIALTQAL KMAEGKKLNV YTGSRYAFAT AHIHGEIYRR
L5_81   501  KAHGTRPDLT DQPLPDADHT WYTDGSSLLH EGQRKAGAAV TTETEVIWAK
ALPAGTSVQR AELIALTQAL KMAEGKKLNV YTDSRYAFAT AHIHGEIYRR
L5_82   501  EAHGTRPDLT DQPLPDADHT WYTGGSSLLQ EGQRKAGATV TTETEVIWAK
ALPAGTSAQR AELIALTQAL KMAEGKKLNV YTDSRYAFAT AHIHGEIYRR
L5_84   501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_85   501  EAHGTRPDLT DQPLPDADHT WYTDGSSLLQ EGQRKAGAAV TTETEVIWAK
ALPAGTSAQR AELIALTQAL KMAEGKKLNV YTASRYAFAT AHIHGEIYRR
```

```
L5_87    501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_88    501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_90    501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_92    501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_93    501  EAHGTRPDLT DQPLPDADHT WYTAGSSLLQ EGQRKAGAAV TTETGVIWAK
ALPAGTSAQR AELIALTQAL KMAEGKKLNV YTDSRYAFAT AHIHGEIYRR
L5_94    501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_95    501  EAHGTRPDLT DQPLPDADHT WYTDGSSLLQ EGQRKAGAAV TTETEVIWAK
ALPAGTSAQR AELIALTQAL KMAEGKKLNV YTGSRYAFAT AHIHGEIYRR
L5_96    501  EAHGTRPDLT DQPLPDADHT WYTDGSSLLQ EGQRKAGAAV TTETEVIWAK
ALPAGTSAQR AELIALTQAL KMAEGKKLNV YTASRYAFAT AHIHGEIYRR
L5_97    501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_99    501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_101   501  EAHGTRPDLT DQPLPDADHT WYTDGSSLLQ EGQRKAGAAV TTETEVIWAK
ALPAGTSAQR AELIALTQAL KMAEGKKLNV YTNSRYAFAT AHIHGEIYRR
L5_103   501  EAHGTRPDLT DQPLPDADHT WYTDGSSLLQ EGQRKAGAAV TTETEVIWAK
ALPAGTSAPR AELIALTQAL KMAEGKKLNV YTDSRYAFAT AHIHGEIYRR
L5_104   501  EAHGTRPDLT DQPLPDADHT WYTGGSSLLQ EGKRKAGAAV TTETEVIWAK
ALPAGTSAQR AELIALTQAL KMAEGKKLNV YTDSRYAFAT AHIHGEIYRR
L5_106   501  EAHGTRPDLT DQPLPDADHT WYTGGSSLLQ EGQRKAGAAV TTETEVIWAK
ALPAGTSAQR AELIALTQAL KMAEGKKLNV YTNSRYAFAT AHIHGEIYRR
L5_107   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_111   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_112   501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_114   501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_115   501  EAHGTRPDLT DQPLPDADHT WYTGGSSLLQ EGQRKAGAAV TTETEVIWAK
ALPAGTSAQR AELIALTQAL KMAEGKKLNV YTDSRYAFAT AHIHGEIYRR
L5_116   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_117   501  EAHGTRPDLT DQPLPDADHT WYTGGSSLLQ ERQRKAGAAV TTETEVIWAK
ALPAGTSAQR AELIALTQAL KMAEGKKLNV YTDSRYAFAT AHIHGEIYRR
L5_118   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
L5_120   501  EAHGTRPDLT DQPLPDADHT WYTDGSSLLQ EGQRKAGAAV TTETEVIWAK
ALPAGTSAQR AELIALTQAL KMAEGKKLNV YTDSRYAFAT AHIHGEIYRR
```

```
MLV   601  RGLLTSEGKE IKNKDEILAL LKALFLPKRL SIIHCPGHQK GHSAEARGNR
MADQAARKAA ITETPDTSTL LIENSSPNSR LIN
1     601  RGLLTSEGKE IKNKDEILAL LKALFLPKRL SIIHCPGHQK GHSAEARGNR MADQAARKAA
ITETPDTSTL LIENSSPNSR LIN
3     601  RRWLTSEGKE IKNKDEILAL LKALFLPKRL SIIHCPGHQK GHSAEARGNR MADQAARKAA
ITETPDTSTL LIENSSPNSR LIN
5     601  RGLLTSEGKE IKNKDEILAL LKALFLPKRL SIIHCPGHQK GHSAEARGNR MANQAARKAA
ITETPDTSTL LIENSSPNSR LIN
7     601  RGLLTSEGKE IKNKDEILAL LKALFLPKRL SIIHCPGHQK GHSAEARGNR MADQAARKAA
ITETPDTSTL LIENSSPNSR LIN
8     601  RGLLTSKGKE IKNKDEILAL LKALFLPKRL SIIHSPGHQK GHSAEARGNR MADQAARKAA
ITDTPDTSTL LIENSSPNSR LIN
10    601  RGLLTSEGKE IKNKDEILAL LKALFLPKRL SIIHCPGHQK GHSAEARGNR MADQAARKAA
ITETPDTSTL LIENSSPNSR LIN
11    601  RGLLTSEGKE IKNKDEILAL LKALFLPKRL SIIHCPGHQK GHSAEARGNR MAAQAARKAA
ITETPDTSTL LIENSSPNSR LIN
12    601  RGLLTSEGKE IKNKDEILAL LKVLFLPKRL SIIHCPGHQK GHSAEARGNR MADQAARKAA
ITETPDTSTL LIENSSPNSR LIN
13    601  RGWLTSEGKE IKNKDEILAL LKALFLPKRL SIIHCPGHQK GHSAEARGNR MADQAARKAA
ITETPDTSTL LIENSSPNSR LIN
16    601  RGLLTSEGKE IKNKDEILAL LKALFLPKRL SIIHCPGHQK GHSAEARGNR MADQATRKAA
ITETPDTSTL LIENSSPNSR LIN
17    601  RGLLTSEGKE IKNKDEILAL LKALFLPKRL SIIHCPGHQK GHSAEARGNR MADQAARKAA
ITETPDTSTL LIENSSPNSR LIN
18    601  RGLLTSEGKE IKNKDEIVAL LKALFLPKRL SIIHCPGHQK GHSAEARGNR MADQAARKAA
ITETPDTSTL LIENSSPPA
20    601  RGWLTSEGKE IKNKDEILAL LKALFLPKRL SIIHCPGHQK GHSAEARGNR MADQAARKAA
ITETPDTSTL LIENSSPPA
21    601  RGLLTSEGKE IKNKDEILAL LKALFLPKRL SIIHCPGHQK GHSAEARGNR MADQAARKAA
ITETPDTSTL LIENSSPPA
23    601  RGLLTSEGKE IKNKDEILAL LKALFLPKRL SIIHCPGHQK GHSVEARGNR MADQAARKAA
VTETPDTSTL LIENSSPNSR LIN
28    601  RGLLTSEGKE IKNKDEILAL LKALFLPKRL STIHCPGHQK GHSVEARGNR MADQAARKAA
ITETPDTSTL LIENSSPNSR LIN
30    601  RGLLTSEGKE IKNKDEILAL LKALFLPKRL SIIHCPGHQK GHSAEARGNR MADQAARKAA
ITETPDTSTL LIENSSPNSR LIN
L5_1  601  RGLLTSEGKE IKNKDEILAL LKALFLPKRL SIIHCPGHQK GHSAEARGNR
MADQAARKAA ITETPDTSTL LIENSSPNSR LIN
L5_2  601  RGLLTSEGKE IKNKDEILAL LKALFLPKRL SIIHCPGHQK GHSAEARGNR
MADQAARKAA ITETPDTSTL LIENSSPNSR LIN
L5_3  601  RGWLTSEGKE IKNKDEILAL LRALFLPKRL SIIHCPGHQK GHSAEARGNR
MADQAARQAA ITETPDTPTL LIENSSPNSR LIN
L5_4  601  RGLLTSEGKE IKNKDEILAL LKALFLPKRL SIIHCPGKQK GHSAEARGNR
MADQAARKAA ITETPDTSTL LIENSSPNSA
L5_6  601  RGLLTSEGKE IKNKDEILAL LKALFLPKRL SIIHCPGHQK GHSAEARGNR
MADQAARKAA ITETPDTSTL LIENSSPNSP
L5_8  601  RGLLTSEGKE IKNKDEILAL LKALFLPKRL SIIHCPGHQK GHSAEARGNR
MADQAARKAA ITETPDTSTL LIENSSPNPA
L5_9  601  RGLLTSEGKE IKNKDEILAL LKALFLPKRL SIIHCPGHQK GHSAEARGNR
MADQAARKAA ITETPDTSTL LIENSSPNSR LIN
L5_11 601  RGLLTSAGKE IKNKDEILAL LKALFLPKRL SIIHCPGHQK GHSAEARGNR
MADQAARKAA ITETPDTSTL LIENSSPNSR LIN
L5_13 601  RGLLTSEGKE IKNKDEILAL LKALFLPKRL SIIHCPGHQK GHSAEARGNR
MADQAARKAA ITETPDTSTL LIENSSPNSR LIN
L5_14 601  RGWLTSEGKE IKNKDEILAL LKALFLPKRL SIIHCPGHQK GHSAEARGNR
MADQAARKAA ITETPDTSTL LIENSSPNSR LIN
```

L5_15  601  RGLLTSEGKE IKNKDEILAL LKALFLPKRL SIIHCPGHQK GHSAEARGNR
MAGQAARKAA ITETPDTSTL LIENSSPNSR LIN
L5_16  601  RGMLTSEGKE IKNKDEILAL LKALFLPKRL SIIHCPGHQK GHSAEARGNR
MADQAARKAA ITETPDTSTL LIENSSPNSR LIN
L5_18  601  RGLLTSEGKE IKNKDEILAL LKALFLPKRL SIIHCPGHQK GHSAEARGNR
MADQVARKAA ITETPDTSTL LIENSSPNSR LIN
L5_20  601  RGWLTSEGKE IKNKDEILAL LKALFLPKRL SIIHCPGHQK GHSAEARGNR
MADQAARKAA ITETPDTSTL LIENSSPNSR LIN
L5_21  601  RGWLTSEGKE IKNKDEILAL LKALFLPKRL SIIHCPGRQK GHSAEARGNR
MANQAARKAA ITETPDTSTL LIENSSPNSR LIN
L5_23  601  RGLLTSEGKE IKNKDEILAL LKALFLPKRL SIIHCPGHQK GHSAEARGNR
MADQAARKAA ITETPDTSTL LIENSSPNSR LIN
L5_24  601  RGWLTSEGKE IKNKDEILAL LKALFLPKRL SIIHCPGHQK GHSAEARGSR
MADQAARRAA ITETPDTSTL LIENSSPNSR LIN
L5_25  601  RGLLTSEGKE IKNKDEILAL LKALFLPERL SIIHCPGHQK GHSAEARGNR
MADQAARKAA ITETPDTSTL LIENSSPNSR LIN
L5_28  601  RGLLTSEGKE IKNKDEILAL LKALSLPKRL SIIHCPGHQK GHSAEARGNR
MADQAARKAA ITETPDTSTL LIENSSPNSR LIN
L5_29  601  RGLLTSEGKE IKNKDEILAL LKALFLPKRL SIIHCPGHQK GHSAEARGNR
MADQAARKAA ITETPDTSTL LIENSSPNSR LIN
L5_30  601  RGLLTSEGKE IKNKDEILAL LKALFLPKRL SIIHCPGHQK GHSAEARGNR
MADQAARKAA ITETPDTSTL PIENSSPNSR LIN
L5_32  601  RGLLTSEGKE IKNKDEILAL LKALFLPKRL SIIHCPGHQK GHSAEARGNR
MADQAARKAA ITETPDTSTL LIENSSPNFR LIN
L5_35  601  RGLLTSEGKE IKNKDEILAL LKALFLPKRL SIIHCPGHQK GHSAEARGNR
MADQAARKAA ITETPDTSTL LIENSSPNSR LIN
L5_37  601  RGLLTSEGKE IKNKDEILAL LKALFLPKRL SIIHCPGHQK GHSAEARGNR
MADQAARKAA ITETPDTSTL LIENSSPNSR LIN
L5_39  601  RGLLTSEGKE IKNKDEILAL LKALFLPKRL SIIHCPGHQK GHSAEVRGNR
MADQAARKAA ITETPDTSTL LIENSSPNSR LIN
L5_40  601  RGLLTSEGKE IKNKDEILAL LKALFLPKRL SIIHCPGHQK GHSAEARGNR
MAGQAARKAA ITETPDTSTL LIENSSPNSR
L5_41  601  RGLLTSEGKE IKNKDEILAL LKALFLPKRL SIIHCPGHQK GHSAEARGNR
MADQAARKAA ITETPDTSTL LIENSSPNSR LIN
L5_42  601  RGWLTSEGKE IKNKDEILAL LKALFLPKRL SIIHCPGHQK GHSAEARGNR
MADQAARKAA ITETPDTSTL LIENSSPNSR LIN
L5_43  601  RGLLTSEGKE IKNKDEILAL LKALSLPKRL SIIHCPGHQK GHSAEARGNR
MANQAARKAA ITETPDTSTL LIENSSPNSR LIN
L5_44  601  RGLLTSEGKE IKNKDEILAL LKALFLPKRL SIIHCPGHQK GHSAEARGNR
MADQAARKAA ITETPDTSTL LIENSSPNSR LIN
L5_46  601  RGLLTSEGKE IKNKDEILAL LKALFLPKRL SIIHCPGHQK GHSTEARGNR
MADQAARKAA ITETPDTSTL LIENSSPNSR LIN
L5_47  601  RGLLTSEGKE IKNKDEILAL LKALFLPKRL SIIHCPGHQK GYSAEARGNR
MANQAARKAA ITETPDTSTL LIENSSPNSR LIN
L5_48  601  RGLLTSEGKE IKNKDEILAL LKALFLPKRL SIIHCPGHQK GHSAEARGNR
MADQAARKAA ITETPDTSTL LIENSSPNSR LIN
L5_49  601  RGLLTSEGKE IKNKDEILAL LKALFLPKRL SIIHCPGHQK GHSAEARGNR
MADQAARKAA ITETPDTSTL LIENSSPNSR LIN
L5_51  601  RGLLTSEGKE IKNKDEILAL LKALFLPKRL SIIHCPGHQK GHSAEARGNR
MANQAARKAA ITETPDTSTL LIENSSPNSR LIN

```
L5_52   601  RGLLTSEGKE IKNKDEILAL LKALFLPKRL SIIHCPGHQK GHSAEARGNR
MADQAARKAA ITETPDTSTL LIENSSPNSR LIN
L5_53   601  RGLLTSEGKE IKNKDEILAL LKALFLPKRL SIIYCPGHQK GHSAEARGNR
MADQAARKAA ITETPDTSTL LIENSSPNSR LIN
L5_55   601  RGLLTSEGKE IKNKDEILAL LKALFLPKRL SIIHCPGHQK GHSAEARGNR
MAHQAARKAA ITETPDTSTL PIENSSPNSR LIN
L5_56   601  RGLLTSEGKE IKNKDEILAL LKALFLPKRL SIIHCPGHQK GHSAEARGNR
MADQAARKAA ITETPDTSTL LIENSSPNSR LIN
L5_57   601  RGWLTSEGKE IKNKDEILAL LKALFLPKRL SIIHCPGHQK GHSAEARGNR
MADQAARKAA ITETPDTSSL LIENSSPNSR LIN
L5_58   601  RGLLTSEGKE IKNKDEILAL LKALFLPKRL SIIHCPGHQK GHSAEARGNR
MAVQAARKAA ITETPDTSTL LIENSSPNSR LIN
L5_59   601  RGLLTSEGKE IKNKDEILAL LKALFLPKRL SIIHCPGHQK GHSAEARGNR
MADQAARKAA ITETPDTSTL LIENSSPNSR LIN
L5_60   601  RGLLTSEGKE IKNKDEILAL LKALFLPKRL SIIHCPGHQK GHSAEARGNR
MANQAARKAA ITETPDTSTL LIENSSPNSR LIN
L5_61   601  RGLLTSEGKE IKNKDEILAL LKALFLPKRL SIIHCPGHQK GHSAEARGNR
MADQAARKAA ITETPDTSTL LIENSSPNSR LIN
L5_62   601  RGLLTSEGKE IKNKDEILAL LKALFLPKRL SIIHCPGHQK GHSAEARGNR
MADQAARKAA ITETPDTSTL LIENSSPNSR LIN
L5_63   601  RGLLTSEGKE IKNKDEILAL LKALFLPKRL SIIHCPGHQK GHSAEARGNR
MADQAARKAA ITETPDTSTL LIENSSPNSR LIN
L5_64   601  RGLLTSEGKE IKNKDEILAL LKALFLPKRL SIIHCPGHQK GHSAEARGNR
MADQAARKAA ITETPDTSTL LIENSSPNSR LIN
L5_65   601  RGWLTSEGKE IKNKDEILAL LKALFLPKRL SIIHCPGHQK GHSAEARGNR
MADQAARKAA ITETPDTSTL LIENSSPNSR LIN
L5_66   601  RGWLTSEGKE IKNKDEILAL LKALFLPKRL SIIHCPGHQK GHSAEARGNR
MADQAARKAA ITETPDTSTL LIENSSPNSR LIN
L5_68   601  RGLLTSEGKE IKNKDEILAL LKALLLPKRL SIIHCPGHQK GHSAEARGNR
MAHQAARKAA ITETPDTSTL LIENSSPNSR LIN
L5_69   601  RGWLTSEGKE IKNKDEILAL LKALFLPKRL SIIHCPGHQK GHSAEARGNR
MANQAARKAA ITETPDTSTL LIENSSPNSR LIN
L5_71   601  RGLLTSEGKE IKNKDEILAL LKALFLPKRL SIIHCPGHQK GHSAEARGNR
MADQAARKAA ITETPDTSTL LIENSSPNSR LIN
L5_72   601  RGLLTSEGKE IKNKDEILAL LKALFLPKRL SIIHCPGHQK GHSAEARGNR
MADQAARKAA ITETPDTSTL PIENSSPNSR LIN
L5_73   601  RGLLTSEGKE IKNKDEILAL LKALFLPKRL SIIHCPGHQK GHSAEARGNR
MADQAARKAA ITETPDTSTL LIENSSPNSR LIN
L5_75   601  RGLLTSEGKE IKNKDKILAL LKALFLPKRL SIIHCPGHQK GHSAEARGSR
MADQAARRAA ITETPDTSTL LIGNSSPNSR LIN
L5_76   601  RGLLTSEGKE IKNKDEILAL LKALFLPKRL SIIHCPGHQK GHSAEARGNR
MADQAARKAA ITETPDTSTL LIENSSPNSR LIN
L5_78   601  RGLLTSEGKE IKNKDEILAL LKALFLPKRL SIIHCPGHQK GHSAEARGNR
MAGQAARKAA ITETPDASTL LIENSSPNSR LIN
L5_79   601  RGLLTSEGKE IKNKDKILAL LKALFLPKRL SIIHCPGHQK GHSAEARGSR
MADQAARRAA ITETPDTSTL LIGNSSPNSR LIN
L5_80   601  RGLLTSEGKE IKNKDEILAL LKALFLPKRL SIIHCPGHQK GHSAEARGNR
MADQAARKAA ITETPDTSTL LIENSPPNSR LIN
L5_81   601  RGLLTSEGKE IKNKDEILAL LKALFLPKRL SIIHCPGHQK GHSAEARGNR
MADQAARKAA ITETPDTSTL LIENSSPNSR LIN
L5_82   601  RGWLTSEGKE IKNKDEILAL LKALFLPKRL SIIHCPGHQK GHSAEARGNR
MANQAARKAA ITETPDTSTL LIENSPPNSR LIN
L5_84   601  RGLLTSEGKE IKNKDEILAL LKALFLPKRL SIIHCPGHQK GHSAEARGNR
MAAQAARKAA ITETPDTSTL LIENSSPNSR LIN
L5_85   601  RGLLTSEGKE IKNKDEILAL LKALFLPKRL SIIHCPGRQK GHSAEARGNR
MADQAARKAA ITETPDTSTL LIENSSPNSR LIN
```

L5_87    601  RGLLTSEGKE IKNKDEILAL LKALFLPKRL SIIHCPGHQK GHSAEARGNR
MADQAARKAA ITETPDTSTL LIENSSPNSR LIN
L5_88    601  RGLLTSEGKE IKNKDEILAL LKALLLPKRL SIIHCPGHQK GHSAEARGNR
MADQAARKAA ITETPDTSTL LIENSSPNSR LIN
L5_90    601  RGLLTSEGKE IKNKDEILAL LKALFLPKRL SIIHCPGHQK GHSAEARGNR
MADQAARKAA ITETPDTSTL LIENSSPNSR LIN
L5_92    601  RGLLTSEGKE IKNKDEILAL LKALFLPKRL SIIHCPGHQK GHSAEARGNR
MAGQAARKAA ITETPDTSTL LIENSSPNSR LIN
L5_93    601  RGLLTSEGKE IKNKDEILAL LKALFLPKRL SIIHCPGHQK GHSAEARGNR
MADQAARKAA ITETPDTSTL LIENSSPNSR LIN
L5_94    601  RGLLTSKGKE IKNKDEILAL LKALFLPKRL SIIHCPGHQK GHSAEARGNR
MADQAARKAA ITETPDTSTL LIENSSPNSR LIN
L5_95    601  RGLLTSEGKE IKNKDEVAL LKALFLPKRL SIIHCPGHQK GHSAEARGNR
MADQAARKAA ITETPDTSTL LIENSSPNSR LIN
L5_96    601  RGLLTSEGKE IKNKDEILAL LKALFLPKRL SIIHCPGRQK GHSAEARGNR
MADQAARKAA ITETPDTSTL LIENSSPNSR LIN
L5_97    601  RGLLTSEGKE IKNKDEILAL LKALFLPKRL SIIHCPGHQK GHSAEARGNR
MAAQAARKAA ITETPDTSTL LIENSSPNSR LIN
L5_99    601  RGLLTSEGKE IKNKDEILAL LKALFLPKRL SIIHCPGHQK GHSAEARGNR
MADQAARKAA ITETPDTSTL LIENSSPNSR LIN
L5_101   601  RGLLTSEGKE IKNKDEILAL LKALFLPKRL SIIHCPGHQK GHSAEARGNR
MADQAARKAA ITETPDTSTL LIENSSPNSR LIN
L5_103   601  RGLLTSGGKE IKNKDEILAL LKALFLPKRL SIIHCPGHQK GHSAEARGNR
MADQAARKAA ITETPDTSTL LIENSSPNSR LIN
L5_104   601  RGLLTSEGKE IKNKDEILAL LKALFLPKRL SIIHCPGHQK GHSAEARGNR
MADQAARKAA ITETPDTSTL LIENSSPNSR LIN
L5_106   601  RGLLTSEGKE IKNKDEILAL LKALFLPKRL SIIHRPGHQK GHSAEARGNR
MADQAARKAA ITETPDTSTF LIENSSPNSR LIN
L5_107   601  RGLLTSEGKE IKNKDEILAL LKALFLPKRL SITHCPGHQK GRGAEARGNR
MADQAARKAA ITETPDTSTL LIENSSPNSR LIN
L5_111   601  RGWLTSEGKE IKNKDEILAL LKALFLPKRL SIIHCPGRQK GHSAEARGNR
MANQAARKAA ITETPDTSTL LIENSSPNSR LIN
L5_112   601  RGLLTSEGKE IKNKDEILAL LKALSLPKRL SIIHCPGHQK GHSAEARGNR
MANQAARKAA ITETPDTSTL LIENSSPNSR LIN
L5_114   601  RGLLTSEGKE IKNKDEILAL LKALFLPKRL SIIHCPGHQK GHSAEARGNR
MAGQAARKAA ITETPDTSTL LIKNSSPNSR LIN
L5_115   601  RGLLTSEGKE IKNKDEILAL LKVLFLPKRL SIIHCPGHQK GHSAEARGNR
MAAQAARKAA ITETPDTSTL LIENSSPNSR LIN
L5_116   601  RGLLTSEGKE IKNKDEILAL LKALFLPKRL SIIHCPGHQK GHSAEARGNR
MAHQAARKAA IAETPDTSTL LIENSSPNSR LIN
L5_117   601  RGLLTSEGKE IKNKDEILAL LKALFLPKRL SIIHCPGHQK GHSAEARGNR
MADQAARKAA ITETPDTSTL LIENSSPNSR LIN
L5_118   601  RGWLTSEGKE IKNKDEILAL LKALFLPKRL SIIHCPGHQK GHSAEARGNR
MADQAARKAA ITETPDTSTL LIENSSPNSR LIN
L5_120   601  RGWLTSEGKE IKNKDEILAL LKALFLPKRL SIIHCPGHQK GHSAEARGNR
MADQAARKAA ITETPDTSTL LIENSSPNSR LIN

| | | |
|---|---|---|
| L5_9 | 12 mutations, | 83D->N, 135L->P, 166P->S, 214H->R, 222Y->C, 293T->A, 344Y->H, 407P->L, 415A->V, 436A->T, 444V->A, 447P->L |
| 18 | 11 mutations, | 83D->N, 139L->P, 200D->N, 330T->P, 479N->D, 577K->Q, 583D->G, 618L->V, 678N->I, 679S->P, 680R->A |
| L5_79 | 10 mutations, | 74I->T, 104P->R, 325Y->H, 333L->Q, 430Q->R, 597I->T, 616E->K, 649N->S, 658K->R, 673E->G |
| L5_82 | 10 mutations, | 26L->P, 130P->S, 137S->G, 343A->T, 356A->G, 524D->G, 539A->T, 603L->W, 653D->N, 676S->P |
| L5_117 | 10 mutations, | 14S->P, 95N->S, 139L->P, 190Q->R, 333L->Q, 339D->G, 380V->A, 383Q->P, 524D->G, 532G->R |
| 21 | 9 mutations, | 131N->S, 179I->T, 204H->R, 323P->L, 353T->A, 583D->A, 678N->I, 679S->P, 680R->A |
| L5_3 | 9 mutations, | 125I->V, 138G->R, 143H->R, 380V->A, 552L->P, 603L->W, 622K->R, 658K->Q, 668S->P |
| L5_20 | 9 mutations, | 12E->A, 87L->P, 95N->S, 200D->A, 221Q->R, 242A->T, 331G->E, 428M->L, 603L->W |
| L5_75 | 9 mutations, | 11H->Y, 325Y->H, 333L->Q, 430Q->R, 597I->T, 616E->K, 649N->S, 658K->R, 673E->G |
| L5_76 | 9 mutations, | 66M->L, 105G->E, 200D->N, 289M->V, 314I->T, 436A->T, 491L->P, 573A->T, 583D->N |
| 8 | 8 mutations, | 89P->S, 139L->P, 287T->A, 330T->P, 514L->F, 607E->K, 635C->S, 663E->D |
| L5_13 | 8 mutations, | 130P->S, 159R->K, 200D->A, 221Q->R, 330T->P, 449D->G, 524D->G, 583D->E |
| L5_41 | 8 mutations, | 60S->A, 139L->P, 168F->S, 199F->Y, 346E->D, 450R->H, 524D->G, 583D->G |
| L5_68 | 8 mutations, | 39M->V, 49I->V, 91Q->R, 204H->R, 287T->A, 454N->K, 625F->L, 653D->H |
| L5_72 | 8 mutations, | 139L->P, 200D->N, 330T->P, 393A->T, 572M->L, 594H->Q, 671L->P, 672I->T |
| L5_114 | 8 mutations, | 17P->S, 108D->E, 249N->D, 307A->V, 344Y->H, 524D->G, 653D->G, 673E->K |
| L5_115 | 8 mutations, | 8H->P, 139L->P, 197T->A, 200D->G, 358G->W, 524D->G, 623A->V, 653D->A |
| 17 | 7 mutations, | 49I->V, 65P->S, 200D->N, 409C->R, 470V->A, 502A->V, 583D->N |
| L5_15 | 7 mutations, | 17P->S, 108D->E, 249N->D, 307A->V, 344Y->H, 524D->G, 653D->G |
| L5_21, L5_111 | 7 mutations, | 65P->S, 233E->K, 407P->S, 478L->P, 603L->W, 638H->R, 653D->N |
| L5_40 | 7 mutations, | 24T->A, 41L->R, 127P->S, 151L->F, 330T->P, 503H->R, 653D->G |
| L5_47 | 7 mutations, | 107N->S, 126H->R, 128T->A, 179I->V, 200D->N, 642H->Y, 653D->N |
| L5_71 | 7 mutations, | 97P->S, 184T->A, 250L->P, 289M->L, 497D->G, 551A->T, 562E->K |
| L5_78 | 7 mutations, | 11H->R, 148V->M, 330T->P, 459H->R, 502A->V, 653D->G, 667T->A |
| L5_81 | 7 mutations, | 166P->S, 199F->L, 446Q->R, 468D->A, 501E->K, 530Q->H, 558A->V |
| L5_118 | 7 mutations, | 221Q->R, 283A->T, 287T->A, 369F->I, 376Y->C, 434I->T, 603L->W |
| 13 | 6 mutations, | 51P->S, 136L->W, 207L->P, 428M->L, 560R->W, 603L->W |
| L5_30 | 6 mutations, | 200D->A, 330T->P, 449D->G, 479N->D, 583D->N, 671L->P |
| L5_32 | 6 mutations, | 69E->G, 135L->P, 139L->P, 431P->Q, 583D->G, 679S->F |
| L5_43, L5_112 | 6 mutations, | 200D->N, 237Q->R, 330T->P, 524D->G, 625F->S, 653D->N |
| L5_53 | 6 mutations, | 130P->S, 139L->P, 417A->V, 524D->G, 583D->N, 634H->Y |
| L5_56 | 6 mutations, | 8H->P, 211R->W, 292P->L, 486L->P, 524D->A, 594H->R |
| L5_57 | 6 mutations, | 49I->V, 173R->K, 302E->K, 392V->A, 603L->W, 669T->S |
| L5_60 | 6 mutations, | 112V->A, 200D->N, 280L->P, 322A->T, 379G->S, 653D->N |
| L5_62 | 6 mutations, | 118V->A, 204H->R, 282E->G, 346E->D, 524D->A, 528L->I |
| L5_84 | 6 mutations, | 126H->R, 139L->P, 417A->V, 491L->P, 524D->G, 653D->A |
| L5_95 | 6 mutations, | 124D->G, 187R->G, 263Q->R, 494N->K, 583D->G, 618L->V |
| L5_107 | 6 mutations, | 139L->P, 233E->K, 295K->E, 633I->T, 642H->R, 643S->G |

APPENDIX 3 – continued

| | | |
|---|---|---|
| 16 | 5 mutations, | 241R->Q, 259A->T, 311R->H, 544T->I, 656A->T |
| 20 | 5 mutations, | 200D->N, 603L->W, 678N->I, 679S->P, 680R->A |
| 23 | 5 mutations, | 221Q->R, 332T->I, 524D->A, 644A->V, 661I->V |
| L5_2 | 5 mutations, | 5E->K, 43V->I, 184T->A, 391P->L, 543E->K |
| L5_14 | 5 mutations, | 37G->W, 197T->A, 200D->G, 433V->A, 603L->W |
| L5_18 | 5 mutations, | 457M->T, 462A->T, 504G->R, 559Q->R, 655A->V |
| L5_23 | 5 mutations, | 30P->L, 223V->M, 388W->R, 390R->W, 435L->P |
| L5_24 | 5 mutations, | 139L->P, 221Q->R, 603L->W, 649N->S, 658K->R |
| L5_28 | 5 mutations, | 306T->A, 309F->S, 524D->A, 594H->R, 625F->S |
| L5_37 | 5 mutations, | 126H->S, 149L->F, 200D->N, 454N->K, 583D->N |
| L5_49, L5_63 | 5 mutations, | 50I->V, 194N->S, 204H->R, 287T->A, 524D->A |
| L5_55 | 5 mutations, | 5E->K, 200D->N, 240T->A, 653D->H, 671L->P |
| L5_69 | 5 mutations, | 14S->T, 49I->T, 538A->T, 603L->W, 653D->N |
| L5_88 | 5 mutations, | 70A->V, 139L->P, 479N->D, 524D->G, 625F->L |
| L5_101 | 5 mutations, | 65P->S, 204H->R, 283A->D, 391P->S, 583D->N |
| L5_104 | 5 mutations, | 132P->S, 164S->G, 388W->R, 524D->G, 533Q->K |
| 3 | 4 mutations, | 221Q->R, 428M->L, 602G->R, 603L->W |
| 5 | 4 mutations, | 139L->P, 283A->D, 358G->V, 653D->N |
| 7 | 4 mutations, | 204H->R, 433V->A, 524D->G, 572M->I |
| 11 | 4 mutations, | 29F->L, 148V->M, 390R->W, 653D->A |
| 12 | 4 mutations, | 23S->P, 88V->A, 237Q->R, 623A->V |
| 30 | 4 mutations, | 200D->N, 306T->M, 524D->N, 583D->G |
| L5_1 | 4 mutations, | 249N->D, 409C->R, 470V->A, 502A->V |
| L5_6 | 4 mutations, | 287T->A, 524D->A, 594H->R, 680R->P |
| L5_8 | 4 mutations, | 475V->G, 524D->G, 679S->P, 680R->A |
| L5_11 | 4 mutations, | 15K->T, 200D->N, 576K->R, 607E->A |
| L5_16 | 4 mutations, | 91Q->L, 583D->G, 600R->K, 603L->M |
| L5_29 | 4 mutations, | 174D->G, 312L->P, 502A->V, 524D->G |
| L5_39 | 4 mutations, | 12E->V, 86I->V, 200D->N, 646A->V |
| L5_42 | 4 mutations, | 192F->L, 333L->P, 556T->A, 603L->W |
| L5_44 | 4 mutations, | 92S->P, 430Q->R, 479N->D, 583D->N |
| L5_46 | 4 mutations, | 200D->N, 330T->P, 583D->N, 644A->T |
| L5_52 | 4 mutations, | 200D->N, 330T->P, 374Q->R, 583D->N |
| L5_61 | 4 mutations, | 64Y->C, 351L->V, 449D->A, 530Q->H |
| L5_64, L5_93 | 4 mutations, | 200D->N, 216D->G, 524D->A, 545E->G |
| L5_65 | 4 mutations, | 200D->N, 238Q->H, 570L->I, 603L->W |
| L5_85, L5_96 | 4 mutations, | 200D->N, 330T->P, 583D->A, 638H->R |
| L5_90 | 4 mutations, | 200D->N, 298R->G, 330T->P, 374Q->R |
| L5_103 | 4 mutations, | 96T->M, 200D->N, 559Q->P, 607E->G |
| L5_106 | 4 mutations, | 524D->G, 583D->N, 635C->R, 670L->F |
| L5_120 | 4 mutations, | 252Y->H, 308G->S, 441E->G, 603L->W |
| 1 | 3 mutations, | 49I->V, 524D->A, 594H->R |
| 28 | 3 mutations, | 8H->R, 632I->T, 644A->V |
| L5_4 | 3 mutations, | 208A->V, 225D->G, 680R->A |
| L5_25 | 3 mutations, | 39M->L, 302E->K, 628K->E |
| L5_35 | 3 mutations, | 200D->N, 330T->P, 479N->D |
| L5_51 | 3 mutations, | 110R->G, 431P->Q, 653D->N |
| L5_58 | 3 mutations, | 66M->L, 90C->Y, 653D->V |
| L5_66 | 3 mutations, | 93P->L, 457M->R, 603L->W |
| L5_73 | 3 mutations, | 67S->P, 139L->P, 307A->V |
| L5_80 | 3 mutations, | 326P->S, 583D->G, 676S->P |
| L5_92 | 3 mutations, | 126H->S, 200D->N, 653D->G |

| | | |
|---|---|---|
| L5_94 | 3 mutations, | 494N->D, 524D->G, 607E->K |
| L5_97 | 3 mutations, | 484L->P, 498I->V, 653D->A |
| 10 | 2 mutations, | 481A->T, 524D->G |
| L5_59 | 2 mutations, | 450R->H, 503H->R |
| L5_99 | 2 mutations, | 36T->I, 524D->G |
| L5_116 | 2 mutations, | 653D->H, 662T->A |
| L5_48 | 1 mutations, | 77H->R |
| WT_MLV, L5_87 | 0 mutations | |

APPENDIX 4

Position 524, total mutations 31, 3 different amino acids
    D->G, 20 sequences (7, 10, L5_8, L5_13, L5_15, L5_29, L5_41, L5_43, L5_53, L5_82, L5_84, L5_88, L5_94, L5_99, L5_104, L5_106, L5_112, L5_114, L5_115, L5_117)
    D->A, 10 sequences (1, 23, L5_6, L5_28, L5_49, L5_56, L5_62, L5_63, L5_64, L5_93)
    D->N, 1 sequences (30)

Position 200, total mutations 30, 3 different amino acids
    D->G, 2 sequences (L5_14, L5_115)
    D->A, 3 sequences (L5_13, L5_20, L5_30)
    D->N, 25 sequences (17, 18, 20, 30, L5_11, L5_35, L5_37, L5_39, L5_43, L5_46, L5_47, L5_52, L5_55, L5_60, L5_64, L5_65, L5_72, L5_76, L5_85, L5_90, L5_92, L5_93, L5_96, L5_103, L5_112)

Position 653, total mutations 23, 5 different amino acids
    D->V, 1 sequences (L5_58)
    D->G, 5 sequences (L5_15, L5_40, L5_78, L5_92, L5_114)
    D->A, 4 sequences (11, L5_84, L5_97, L5_115)
    D->N, 10 sequences (5, L5_21, L5_43, L5_47, L5_51, L5_60, L5_69, L5_82, L5_111, L5_112)
    D->H, 3 sequences (L5_55, L5_68, L5_116)

Position 583, total mutations 21, 4 different amino acids
    D->E, 1 sequences (L5_13)
    D->G, 7 sequences (18, 30, L5_16, L5_32, L5_41, L5_80, L5_95)
    D->A, 3 sequences (21, L5_85, L5_96)
    D->N, 10 sequences (17, L5_30, L5_37, L5_44, L5_46, L5_52, L5_53, L5_76, L5_101, L5_106)

Position 603, total mutations 18, 2 different amino acids
    L->W, 17 sequences (3, 13, 20, L5_3, L5_14, L5_20, L5_21, L5_24, L5_42, L5_57, L5_65, L5_66, L5_69, L5_82, L5_111, L5_118, L5_120)
    L->M, 1 sequences (L5_16)

Position 330, total mutations 15, 1 different amino acids
    T->P, 15 sequences (8, 18, L5_13, L5_30, L5_35, L5_40, L5_43, L5_46, L5_52, L5_72, L5_78, L5_85, L5_90, L5_96, L5_112)

Position 139, total mutations 14, 1 different amino acids
    L->P, 14 sequences (5, 8, 18, L5_24, L5_32, L5_41, L5_53, L5_72, L5_73, L5_84, L5_88, L5_107, L5_115, L5_117)

Position 204, total mutations 7, 1 different amino acids
    H->R, 7 sequences (7, 21, L5_49, L5_62, L5_63, L5_68, L5_101)

Position 221, total mutations 6, 1 different amino acids
    Q->R, 6 sequences (3, 23, L5_13, L5_20, L5_24, L5_118)

Position 287, total mutations 6, 1 different amino acids
    T->A, 6 sequences (8, L5_6, L5_49, L5_63, L5_68, L5_118)

Position 680, total mutations 6, 2 different amino acids
    R->P, 1 sequences (L5_6)
    R->A, 5 sequences (18, 20, 21, L5_4, L5_8)

Position 49, total mutations 5, 2 different amino acids

I->T, 1 sequences (L5_69)
I->V, 4 sequences (1, 17, L5_57, L5_68)

APPENDIX 4 continued

Position 479, total mutations 5, 1 different amino acids
N->D, 5 sequences (18, L5_30, L5_35, L5_44, L5_88)

Position 594, total mutations 5, 2 different amino acids
H->Q, 1 sequences (L5_72)
H->R, 4 sequences (1, L5_6, L5_28, L5_56)

Position 625, total mutations 5, 2 different amino acids
F->S, 3 sequences (L5_28, L5_43, L5_112)
F->L, 2 sequences (L5_68, L5_88)

Position 679, total mutations 5, 2 different amino acids
S->F, 1 sequences (L5_32)
S->P, 4 sequences (18, 20, 21, L5_8)

Position 65, total mutations 4, 1 different amino acids
P->S, 4 sequences (17, L5_21, L5_101, L5_111)

Position 126, total mutations 4, 2 different amino acids
H->S, 2 sequences (L5_37, L5_92)
H->R, 2 sequences (L5_47, L5_84)

Position 333, total mutations 4, 2 different amino acids
L->Q, 3 sequences (L5_75, L5_79, L5_117)
L->P, 1 sequences (L5_42)

Position 502, total mutations 4, 1 different amino acids
A->V, 4 sequences (17, L5_1, L5_29, L5_78)

Position 607, total mutations 4, 3 different amino acids
E->G, 1 sequences (L5_103)
E->A, 1 sequences (L5_11)
E->K, 2 sequences (8, L5_94)

Position 638, total mutations 4, 1 different amino acids
H->R, 4 sequences (L5_21, L5_85, L5_96, L5_111)

Position 658, total mutations 4, 2 different amino acids
K->Q, 1 sequences (L5_3)
K->R, 3 sequences (L5_24, L5_75, L5_79)

Position 8, total mutations 3, 2 different amino acids.
H->P, 2 sequences (L5_56, L5_115)
H->R, 1 sequences (28)

Position 130, total mutations 3, 1 different amino acids
P->S, 3 sequences (L5_13, L5_53, L5_82)

Position 233, total mutations 3, 1 different amino acids
E->K, 3 sequences (L5_21, L5_107, L5_111)

Position 237, total mutations 3, 1 different amino acids
Q->R, 3 sequences (12, L5_43, L5_112)

Position 249, total mutations 3, 1 different amino acids
N->D, 3 sequences (L5_1, L5_15, L5_114)

APPENDIX 4 continued

Position 283, total mutations 3, 2 different amino acids
A->D, 2 sequences (5, L5_101)
A->T, 1 sequences (L5_118)

Position 307, total mutations 3, 1 different amino acids
A->V, 3 sequences (L5_15, L5_73, L5_114)

Position 344, total mutations 3, 1 different amino acids
Y->H, 3 sequences (L5_9, L5_15, L5_114)

Position 407, total mutations 3, 2 different amino acids
P->S, 2 sequences (L5_21, L5_111)
P->L, 1 sequences (L5_9)

Position 428, total mutations 3, 1 different amino acids
M->L, 3 sequences (3, 13, L5_20)

Position 430, total mutations 3, 1 different amino acids
Q->R, 3 sequences (L5_44, L5_75, L5_79)

Position 449, total mutations 3, 2 different amino acids
D->G, 2 sequences (L5_13, L5_30)
D->A, 1 sequences (L5_61)

Position 644, total mutations 3, 2 different amino acids
A->T, 1 sequences (L5_46)
A->V, 2 sequences (23, 28)

Position 649, total mutations 3, 1 different amino acids
N->S, 3 sequences (L5_24, L5_75, L5_79)

Position 671, total mutations 3, 1 different amino acids
L->P, 3 sequences (L5_30, L5_55, L5_72)

Position 673, total mutations 3, 2 different amino acids
E->G, 2 sequences (L5_75, L5_79)
E->K, 1 sequences (L5_114)

Position 678, total mutations 3, 1 different amino acids
N->I, 3 sequences (18, 20, 21)

Position 5, total mutations 2, 1 different amino acids
E->K, 2 sequences (L5_2, L5_55)

Position 11, total mutations 2, 2 different amino acids

H->R, 1 sequences (L5_76)
H->Y, 1 sequences (L5_75)

Position 12, total mutations 2, 2 different amino acids
    E->V, 1 sequences (L5_39)
    E->A, 1 sequences (L5_20)

Position 14, total mutations 2, 2 different amino acids
    S->T, 1 sequences (L5_69)
    S->P, 1 sequences (L5_117)

APPENDIX 4 continued

Position 17, total mutations 2, 1 different amino acids
    P->S, 2 sequences (L5_15, L5_114)

Position 39, total mutations 2, 2 different amino acids
    M->V, 1 sequences (L5_68)
    M->L, 1 sequences (L5_25)

Position 50, total mutations 2, 1 different amino acids
    I->V, 2 sequences (L5_49, L5_63)

Position 66, total mutations 2, 1 different amino acids
    M->L, 2 sequences (L5_58, L5_76)

Position 83, total mutations 2, 1 different amino acids
    D->N, 2 sequences (18, L5_9)

Position 91, total mutations 2, 2 different amino acids
    Q->R, 1 sequences (L5_68)
    Q->L, 1 sequences (L5_16)

Position 95, total mutations 2, 1 different amino acids
    N->S, 2 sequences (L5_20, L5_117)

Position 108, total mutations 2, 1 different amino acids
    D->E, 2 sequences (L5_15, L5_114)

Position 135, total mutations 2, 1 different amino acids
    L->P, 2 sequences (L5_9, L5_32)

Position 148, total mutations 2, 1 different amino acids
    V->M, 2 sequences (11, L5_78)

Position 166, total mutations 2, 1 different amino acids
    P->S, 2 sequences (L5_9, L5_81)

Position 179, total mutations 2, 2 different amino acids
    I->T, 1 sequences (21)
    I->V, 1 sequences (L5_47)

Position 184, total mutations 2, 1 different amino acids

T->A, 2 sequences (L5_2, L5_71)

Position 194, total mutations 2, 1 different amino acids
N->S, 2 sequences (L5_49, L5_63)

Position 197, total mutations 2, 1 different amino acids
T->A, 2 sequences (L5_14, L5_115)

Position 199, total mutations 2, 2 different amino acids
F->L, 1 sequences (L5_81)
F->Y, 1 sequences (L5_41)

Position 216, total mutations 2, 1 different amino acids
D->G, 2 sequences (L5_64, L5_93)

APPENDIX 4 continued

Position 289, total mutations 2, 2 different amino acids
M->V, 1 sequences (L5_76)
M->L, 1 sequences (L5_71)

Position 302, total mutations 2, 1 different amino acids
E->K, 2 sequences (L5_25, L5_57)

Position 306, total mutations 2, 2 different amino acids
T->A, 1 sequences (L5_28)
T->M, 1 sequences (30)

Position 325, total mutations 2, 1 different amino acids
Y->H, 2 sequences (L5_75, L5_79)

Position 346, total mutations 2, 1 different amino acids
E->D, 2 sequences (L5_41, L5_62)

Position 358, total mutations 2, 2 different amino acids
G->W, 1 sequences (L5_115)
G->V, 1 sequences (5)

Position 374, total mutations 2, 1 different amino acids
Q->R, 2 sequences (L5_52, L5_90)

Position 380, total mutations 2, 1 different amino acids
V->A, 2 sequences (L5_3, L5_117)

Position 388, total mutations 2, 1 different amino acids
W->R, 2 sequences (L5_23, L5_104)

Position 390, total mutations 2, 1 different amino acids
R->W, 2 sequences (11, L5_23)

Position 391, total mutations 2, 2 different amino acids
P->S, 1 sequences (L5_101)

P->L, 1 sequences (L5_2)

Position 409, total mutations 2, 1 different amino acids
    C->R, 2 sequences (17, L5_1)

Position 417, total mutations 2, 1 different amino acids
    A->V, 2 sequences (L5_53, L5_84)

Position 431, total mutations 2, 1 different amino acids
    P->Q, 2 sequences (L5_32, L5_51)

Position 433, total mutations 2, 1 different amino acids
    V->A, 2 sequences (7, L5_14)

Position 436, total mutations 2, 1 different amino acids
    A->T, 2 sequences (L5_9, L5_76)

Position 450, total mutations 2, 1 different amino acids
    R->H, 2 sequences (L5_41, L5_59)

Position 454, total mutations 2, 1 different amino acids
    N->K, 2 sequences (L5_37, L5_68)

APPENDIX 4 continued

Position 457, total mutations 2, 2 different amino acids
    M->T, 1 sequences (L5_18)
    M->R, 1 sequences (L5_66)

Position 470, total mutations 2, 1 different amino acids
    V->A, 2 sequences (17, L5_1)

Position 478, total mutations 2, 1 different amino acids
    L->P, 2 sequences (L5_21, L5_111)

Position 491, total mutations 2, 1 different amino acids
    L->P, 2 sequences (L5_76, L5_84)

Position 494, total mutations 2, 2 different amino acids
    N->D, 1 sequences (L5_94)
    N->K, 1 sequences (L5_95)

Position 503, total mutations 2, 1 different amino acids
    H->R, 2 sequences (L5_40, L5_59)

Position 530, total mutations 2, 1 different amino acids
    Q->H, 2 sequences (L5_61, L5_81)

Position 545, total mutations 2, 1 different amino acids
    E->G, 2 sequences (L5_64, L5_93)

Position 559, total mutations 2, 2 different amino acids
    Q->P, 1 sequences (L5_103)
    Q->R, 1 sequences (L5_18)

Position 572, total mutations 2, 2 different amino acids
    M->L, 1 sequences (L5_72)
    M->I, 1 sequences (7)

Position 597, total mutations 2, 1 different amino acids
    I->T, 2 sequences (L5_75, L5_79)

Position 616, total mutations 2, 1 different amino acids
    E->K, 2 sequences (L5_75, L5_79)

Position 618, total mutations 2, 1 different amino acids
    L->V, 2 sequences (18, L5_95)

Position 623, total mutations 2, 1 different amino acids
    A->V, 2 sequences (12, L5_115)

Position 635, total mutations 2, 2 different amino acids
    C->S, 1 sequences (8)
    C->R, 1 sequences (L5_106)

Position 642, total mutations 2, 2 different amino acids
    H->R, 1 sequences (L5_107)
    H->Y, 1 sequences (L5_47)

Position 676, total mutations 2, 1 different amino acids
    S->P, 2 sequences (L5_80, L5_82)

APPENDIX 4 continued

Position 15, total mutations 1, 1 different amino acids
    K->T, 1 sequences (L5_11)

Position 23, total mutations 1, 1 different amino acids
    S->P, 1 sequences (12)

Position 24, total mutations 1, 1 different amino acids
    T->A, 1 sequences (L5_40)

Position 26, total mutations 1, 1 different amino acids
    L->P, 1 sequences (L5_82)

Position 29, total mutations 1, 1 different amino acids
    F->L, 1 sequences (11)

Position 30, total mutations 1, 1 different amino acids
    P->L, 1 sequences (L5_23)

Position 36, total mutations 1, 1 different amino acids
    T->I, 1 sequences (L5_99)

Position 37, total mutations 1, 1 different amino acids
    G->W, 1 sequences (L5_14)

Position 41, total mutations 1, 1 different amino acids
L->R, 1 sequences (L5_40)

Position 43, total mutations 1, 1 different amino acids
V->I, 1 sequences (L5_2)

Position 51, total mutations 1, 1 different amino acids
P->S, 1 sequences (13)

Position 60, total mutations 1, 1 different amino acids
S->A, 1 sequences (L5_41)

Position 64, total mutations 1, 1 different amino acids
Y->C, 1 sequences (L5_61)

Position 67, total mutations 1, 1 different amino acids
S->P, 1 sequences (L5_73)

Position 69, total mutations 1, 1 different amino acids
E->G, 1 sequences (L5_32)

Position 70, total mutations 1, 1 different amino acids
A->V, 1 sequences (L5_88)

Position 74, total mutations 1, 1 different amino acids
I->T, 1 sequences (L5_79)

Position 77, total mutations 1, 1 different amino acids
H->R, 1 sequences (L5_48)

Position 86, total mutations 1, 1 different amino acids
I->V, 1 sequences (L5_39)

APPENDIX 4 continued

Position 87, total mutations 1, 1 different amino acids
L->P, 1 sequences (L5_20)

Position 88, total mutations 1, 1 different amino acids
V->A, 1 sequences (12)

Position 89, total mutations 1, 1 different amino acids
P->S, 1 sequences (8)

Position 90, total mutations 1, 1 different amino acids
C->Y, 1 sequences (L5_58)

Position 92, total mutations 1, 1 different amino acids
S->P, 1 sequences (L5_44)

Position 93, total mutations 1, 1 different amino acids
P->L, 1 sequences (L5_66)

Position 96, total mutations 1, 1 different amino acids

T->M, 1 sequences (L5_103)

Position 97, total mutations 1, 1 different amino acids
P->S, 1 sequences (L5_71)

Position 104, total mutations 1, 1 different amino acids
P->R, 1 sequences (L5_79)

Position 105, total mutations 1, 1 different amino acids
G->E, 1 sequences (L5_76)

Position 107, total mutations 1, 1 different amino acids
N->S, 1 sequences (L5_47)

Position 110, total mutations 1, 1 different amino acids
R->G, 1 sequences (L5_51)

Position 112, total mutations 1, 1 different amino acids
V->A, 1 sequences (L5_60)

Position 118, total mutations 1, 1 different amino acids
V->A, 1 sequences (L5_62)

Position 124, total mutations 1, 1 different amino acids
D->G, 1 sequences (L5_95)

Position 125, total mutations 1, 1 different amino acids
I->V, 1 sequences (L5_3)

Position 127, total mutations 1, 1 different amino acids
P->S, 1 sequences (L5_40)

Position 128, total mutations 1, 1 different amino acids
T->A, 1 sequences (L5_47)

Position 131, total mutations 1, 1 different amino acids
N->S, 1 sequences (21)

APPENDIX 4 continued

Position 132, total mutations 1, 1 different amino acids
P->S, 1 sequences (L5_104)

Position 136, total mutations 1, 1 different amino acids
L->W, 1 sequences (13)

Position 137, total mutations 1, 1 different amino acids
S->G, 1 sequences (L5_82)

Position 138, total mutations 1, 1 different amino acids
G->R, 1 sequences (L5_3)

Position 143, total mutations 1, 1 different amino acids
H->R, 1 sequences (L5_3)

Position 149, total mutations 1, 1 different amino acids
L->F, 1 sequences (L5_37)

Position 151, total mutations 1, 1 different amino acids
L->F, 1 sequences (L5_40)

Position 159, total mutations 1, 1 different amino acids
R->K, 1 sequences (L5_13)

Position 164, total mutations 1, 1 different amino acids
S->G, 1 sequences (L5_104)

Position 168, total mutations 1, 1 different amino acids
F->S, 1 sequences (L5_41)

Position 173, total mutations 1, 1 different amino acids
R->K, 1 sequences (L5_57)

Position 174, total mutations 1, 1 different amino acids
D->G, 1 sequences (L5_29)

Position 187, total mutations 1, 1 different amino acids
R->G, 1 sequences (L5_95)

Position 190, total mutations 1, 1 different amino acids
Q->R, 1 sequences (L5_117)

Position 192, total mutations 1, 1 different amino acids
F->L, 1 sequences (L5_42)

Position 207, total mutations 1, 1 different amino acids
L->P, 1 sequences (13)

Position 208, total mutations 1, 1 different amino acids
A->V, 1 sequences (L5_4)

Position 211, total mutations 1, 1 different amino acids
R->W, 1 sequences (L5_56)

Position 214, total mutations 1, 1 different amino acids
H->R, 1 sequences (L5_9)

APPENDIX 4 continued

Position 222, total mutations 1, 1 different amino acids
Y->C, 1 sequences (L5_9)

Position 223, total mutations 1, 1 different amino acids
V->M, 1 sequences (L5_23)

Position 225, total mutations 1, 1 different amino acids
D->G, 1 sequences (L5_4)

Position 238, total mutations 1, 1 different amino acids

Q->H, 1 sequences (L5_65)

Position 240, total mutations 1, 1 different amino acids
T->A, 1 sequences (L5_55)

Position 241, total mutations 1, 1 different amino acids
R->Q, 1 sequences (16)

Position 242, total mutations 1, 1 different amino acids
A->T, 1 sequences (L5_20)

Position 250, total mutations 1, 1 different amino acids
L->P, 1 sequences (L5_71)

Position 252, total mutations 1, 1 different amino acids
Y->H, 1 sequences (L5_120)

Position 259, total mutations 1, 1 different amino acids
A->T, 1 sequences (16)

Position 263, total mutations 1, 1 different amino acids
Q->R, 1 sequences (L5_95)

Position 280, total mutations 1, 1 different amino acids
L->P, 1 sequences (L5_60)

Position 282, total mutations 1, 1 different amino acids
E->G, 1 sequences (L5_62)

Position 292, total mutations 1, 1 different amino acids
P->L, 1 sequences (L5_56)

Position 293, total mutations 1, 1 different amino acids
T->A, 1 sequences (L5_9)

Position 295, total mutations 1, 1 different amino acids
K->E, 1 sequences (L5_107)

Position 298, total mutations 1, 1 different amino acids
R->G, 1 sequences (L5_90)

Position 308, total mutations 1, 1 different amino acids
G->S, 1 sequences (L5_120)

Position 309, total mutations 1, 1 different amino acids
F->S, 1 sequences (L5_28)

APPENDIX 4 continued

Position 311, total mutations 1, 1 different amino acids
R->H, 1 sequences (16)

Position 312, total mutations 1, 1 different amino acids
L->P, 1 sequences (L5_29)

Position 314, total mutations 1, 1 different amino acids
I->T, 1 sequences (L5_76)

Position 322, total mutations 1, 1 different amino acids
A->T, 1 sequences (L5_60)

Position 323, total mutations 1, 1 different amino acids
P->L, 1 sequences (21)

Position 326, total mutations 1, 1 different amino acids
P->S, 1 sequences (L5_80)

Position 331, total mutations 1, 1 different amino acids
G->E, 1 sequences (L5_20)

Position 332, total mutations 1, 1 different amino acids
T->I, 1 sequences (26)

Position 339, total mutations 1, 1 different amino acids
D->G, 1 sequences (L5_117)

Position 343, total mutations 1, 1 different amino acids
A->T, 1 sequences (L5_82)

Position 351, total mutations 1, 1 different amino acids
L->V, 1 sequences (L5_61)

Position 353, total mutations 1, 1 different amino acids
T->A, 1 sequences (21)

Position 356, total mutations 1, 1 different amino acids
A->G, 1 sequences (L5_82)

Position 369, total mutations 1, 1 different amino acids
F->I, 1 sequences (L5_118)

Position 376, total mutations 1, 1 different amino acids
Y->C, 1 sequences (L5_118)

Position 379, total mutations 1, 1 different amino acids
G->S, 1 sequences (L5_60)

Position 383, total mutations 1, 1 different amino acids
Q->P, 1 sequences (L5_117)

Position 392, total mutations 1, 1 different amino acids
V->A, 1 sequences (L5_57)

Position 393, total mutations 1, 1 different amino acids
A->T, 1 sequences (L5_72)

APPENDIX 4 continued

Position 415, total mutations 1, 1 different amino acids
　　　A->V, 1 sequences (L5_9)

Position 434, total mutations 1, 1 different amino acids
　　　I->T, 1 sequences (L5_118)

Position 435, total mutations 1, 1 different amino acids
　　　L->P, 1 sequences (L5_23)

Position 441, total mutations 1, 1 different amino acids
　　　E->G, 1 sequences (L5_120)

Position 444, total mutations 1, 1 different amino acids
　　　V->A, 1 sequences (L5_9)

Position 446, total mutations 1, 1 different amino acids
　　　Q->R, 1 sequences (L5_81)

Position 447, total mutations 1, 1 different amino acids
　　　P->L, 1 sequences (L5_9)

Position 459, total mutations 1, 1 different amino acids
　　　H->R, 1 sequences (L5_76)

Position 462, total mutations 1, 1 different amino acids
　　　A->T, 1 sequences (L5_18)

Position 468, total mutations 1, 1 different amino acids
　　　D->A, 1 sequences (L5_81)

Position 475, total mutations 1, 1 different amino acids
　　　V->G, 1 sequences (L5_8)

Position 481, total mutations 1, 1 different amino acids
　　　A->T, 1 sequences (10)

Position 484, total mutations 1, 1 different amino acids
　　　L->P, 1 sequences (L5_97)

Position 486, total mutations 1, 1 different amino acids
　　　L->P, 1 sequences (L5_56)

Position 497, total mutations 1, 1 different amino acids
　　　D->G, 1 sequences (L5_71)

Position 498, total mutations 1, 1 different amino acids
　　　I->V, 1 sequences (L5_97)

Position 501, total mutations 1, 1 different amino acids
　　　E->K, 1 sequences (L5_81)

Position 504, total mutations 1, 1 different amino acids
　　　G->R, 1 sequences (L5_18)

Position 514, total mutations 1, 1 different amino acids
   L->F, 1 sequences (8)

APPENDIX 4 continued

Position 528, total mutations 1, 1 different amino acids
   L->I, 1 sequences (L5_62)

Position 532, total mutations 1, 1 different amino acids
   G->R, 1 sequences (L5_117)

Position 533, total mutations 1, 1 different amino acids
   Q->K, 1 sequences (L5_104)

Position 538, total mutations 1, 1 different amino acids
   A->T, 1 sequences (L5_69)

Position 539, total mutations 1, 1 different amino acids
   A->T, 1 sequences (L5_82)

Position 543, total mutations 1, 1 different amino acids
   E->K, 1 sequences (L5_2)

Position 544, total mutations 1, 1 different amino acids
   T->I, 1 sequences (16)

Position 551, total mutations 1, 1 different amino acids
   A->T, 1 sequences (L5_71)

Position 552, total mutations 1, 1 different amino acids
   L->P, 1 sequences (L5_3)

Position 556, total mutations 1, 1 different amino acids
   T->A, 1 sequences (L5_42)

Position 558, total mutations 1, 1 different amino acids
   A->V, 1 sequences (L5_81)

Position 560, total mutations 1, 1 different amino acids
   R->W, 1 sequences (13)

Position 562, total mutations 1, 1 different amino acids
   E->K, 1 sequences (L5_71)

Position 570, total mutations 1, 1 different amino acids
   L->I, 1 sequences (L5_65)

Position 573, total mutations 1, 1 different amino acids
   A->T, 1 sequences (L5_76)

Position 576, total mutations 1, 1 different amino acids
   K->R, 1 sequences (L5_11)

Position 577, total mutations 1, 1 different amino acids

K->Q, 1 sequences (18)

Position 600, total mutations 1, 1 different amino acids
R->K, 1 sequences (L5_16)

Position 602, total mutations 1, 1 different amino acids
G->R, 1 sequences (3)

APPENDIX 4 continued

Position 622, total mutations 1, 1 different amino acids
K->R, 1 sequences (L5_3)

Position 628, total mutations 1, 1 different amino acids
K->E, 1 sequences (L5_25)

Position 632, total mutations 1, 1 different amino acids
I->T, 1 sequences (28)

Position 633, total mutations 1, 1 different amino acids
I->T, 1 sequences (L5_107)

Position 634, total mutations 1, 1 different amino acids
H->Y, 1 sequences (L5_53)

Position 643, total mutations 1, 1 different amino acids
S->G, 1 sequences (L5_107)

Position 646, total mutations 1, 1 different amino acids
A->V, 1 sequences (L5_39)

Position 655, total mutations 1, 1 different amino acids
A->V, 1 sequences (L5_18)

Position 656, total mutations 1, 1 different amino acids
A->T, 1 sequences (16)

Position 661, total mutations 1, 1 different amino acids
I->V, 1 sequences (23)

Position 662, total mutations 1, 1 different amino acids
T->A, 1 sequences (L5_116)

Position 663, total mutations 1, 1 different amino acids
E->D, 1 sequences (8)

Position 667, total mutations 1, 1 different amino acids
T->A, 1 sequences (L5_78)

Position 668, total mutations 1, 1 different amino acids
S->P, 1 sequences (L5_3)

Position 669, total mutations 1, 1 different amino acids
T->S, 1 sequences (L5_57)

Position 670, total mutations 1, 1 different amino acids
    L->F, 1 sequences (L5_106)

Position 672, total mutations 1, 1 different amino acids
    I->T, 1 sequences (L5_72)

APPENDIX 5

| | Selection frequency* | Conc., mg/ml | Specific activity 37°C (u/mg) | Specific activity 50°C | Specific activity 5 min 50°C => 37°C | RNase H activity u/mol | RNase H activity % | Highest temperature of cDNA synthesis 1kb |
|---|---|---|---|---|---|---|---|---|
| M-MuLV (wt) | | 3.4 | ~200 000 | 45 - 50 % | 11 % | ~160-200 | 100 % | 47.8°C |
| D200N | 25 (30) | 2.91 | 254 000 | 84 % | 15 % | 174 | 97 % | 50.4°C |
| D200A | 3 (30) | 2.73 | 187 000 | 87 % | 18 % | 179 | 99 % | 47.8°C |
| D200Q | | 3.82 | 135 000 | 103 % | 23 % | 161 | 89 % | 47.8°C |
| D200E | | 2.33 | 71 000 | 79 % | 7 % | | | 47.8°C |
| D200V | | 2.04 | 87 000 | 131 % | 2 % | 102 | 57 % | 47.8°C |
| D200W | | 2.84 | 114 000 | 103 % | 4.3 % | | | 47.8°C |
| D200G | 2 (30) | 2.68 | 276 000 | 88 % | 10 % | | | 47.8°C |
| D200P | | 1.15 | 0 | 0 % | 0 % | | | |
| D200K | | 3.14 | 175 000 | 102 % | 2.5 % | | | 47.8°C |
| D200R | | 3.69 | 52 000 | 68 % | 27 % | 171 | 95 % | 45.5°C |
| D200H | | 6.23 | 234 000 | 54 % | 27 % | | | 50.4°C |
| L603W | 17 (18) | 2.41 | 110 000 | 105 % | 23 % | 202 | 112 % | 53.1°C |
| L603F | | 3.18 | 109 000 | 104 % | 9 % | 112 | 62 % | 50.4°C |
| L603Y | | 3.12 | 139 000 | 95 % | 13 % | | | 47.8 - 50.4°C |
| L603P | | 3.24 | 138 000 | 20 % | 15 % | | | 45.5°C |
| L603I | | 2.85 | 178 000 | 33 % | 7 % | 142 | 79 % | |
| L603M | 1 (18) | 3.7 | 149 000 | 77 % | 9 % | 161 | 89 % | 47.8°C |
| L603V | | 2.69 | 190 000 | 39 % | 7 % | | | 45.5°C |
| L603G | | 3.42 | 149 000 | 36 % | 10 % | | | |
| D653N | 10 (23) | 2.39 | 179 000 | 93 % | 21 % | | | 50.4-53.1°C |
| D653K | | 2.38 | 211 000 | 106 % | 15 % | | | 50.4-53.1°C |
| D653A | 4 (23) | 2.98 | 198 000 | 99 % | 18 % | | | 50.4°C |
| D653V | 1 (23) | 2.82 | 172 000 | 98 % | 16 % | | | 50.4°C |
| D653Q | | 2.79 | 182 000 | 93 % | 18 % | | | 50.4°C |
| D653L | | 2.60 | 212 000 | 83 % | 11 % | | | 50.4°C |
| D653H | 3 (23) | 2.41 | 180 000 | 116 % | 13 % | | | 50.4-53.1°C |
| D653G | 5 (23) | 3.05 | 135 000 | 90 % | 13 % | | | 50.4°C |
| D653 | | 2.68 | 178 000 | 93 % | 13 % | | | 50.4°C |

APPENDIX 5 continued

| | Selection frequency* | Conc., mg/ml | Specific activity 37°C (u/mg) | 50°C | 5 min 50°C => 37°C | RNase H activity u/mol | % | Highest temperature of cDNA synthesis 1kb |
|---|---|---|---|---|---|---|---|---|
| W D653E | | 2.46 | 200 000 | 80 % | 19 % | | | 47.8°C |
| T330P | 15 (15) | 1.76 | 154 000 | 80 % | 21 % | 185 | 103 % | 47.8°C |
| T330N | | 2.62 | 223 000 | 69 % | 13 % | | | 47.8°C |
| M-MuLV (wt) | | 3.4 | ~200 000 | 45-50 % | 11 % | ~160-200 | 100 % | 47.8°C |
| T330L | | 3.26 | 128 000 | 49 % | 9 % | | | 45.5°C |
| T330D | | 3.32 | 240 000 | 55 % | 16 % | | | 47.8°C |
| T330V | | 2.56 | 197 000 | 65 % | 12 % | | | 47.8°C |
| T330S | | 2.33 | 201 000 | 67 % | 15 % | | | 47.8°C |
| Q221R | 6 (6) | 2.38 | 268 000 | 94 % | 0 % | 117 | 65 % | 50.4°C |
| Q221N | | 3.09 | 114 000 | 53 % | 10 % | | | 45.5°C |
| Q221H | | 2.47 | 55 000 | 44 % | 8 % | | | 43.6-45.5°C |
| Q221K | | 1.85 | 179 000 | 77 % | 0 % | | | 45.5 |
| Q221E | | 1.85 | 83 000 | 64 % | 0 % | | | 43.6-45.5°C |
| Q221M | | 1.3 | 107 000 | 58 % | 2 % | | | 45.5 |
| Q221Y | | 1.76 | 60 000 | 77 % | 0 % | | | 43.6-45.5°C |
| E607K | 2 (4) | 3.94 | 182 000 | 84 % | 9 % | 260 | 144 % | 47.8-50.4°C |
| E607A | 1 (4) | 4.28 | 204 000 | 98 % | | | | 47.8°C |
| E607G | 1 (4) | 4.02 | 184 000 | 72 % | | | | 47.8°C |
| E607D | | 2.24 | 181 000 | 69 % | | | | 45.5°C |
| E607Q | | 1.02 | 0 | 0 % | | | | |
| L139P | 14 (14) | 1.34 | 148 000 | 59 % | 7 % | 176 | 98 % | 47.8°C |
| T287A | 6 (6) | 2.34 | 204 000 | 52 % | 13 % | 174 | 96 % | 45.5-47.8°C |
| T287S | | 2.75 | 213 000 | 68 % | 11 % | | | 45.5-47.8°C |
| T287L | | 2.28 | 179 000 | 38 % | 11 % | | | 45.5°C |
| T287N | | 2.46 | 197 000 | 50 % | 12 % | | | 45.5°C |
| T287F | | 2.18 | 190 000 | 48 % | 13 % | | | 45.5°C |
| T287P | | 1.64 | 134 000 | 7 % | 11 % | | | 41.9°C |
| N479D | 5 (5) | 3.15 | 190 000 | 81 % | 9 % | 234 | 130 % | 47.8°C |
| N479Q | | 2.82 | 176 000 | 33 % | | | | 43.6°C |

APPENDIX 5 continued

| | Selection frequency* | Conc., mg/ml | Specific activity 37°C (u/mg) | Specific activity 50°C | Specific activity 5 min 50°C => 37°C | RNase H activity u/mol | RNase H activity % | Highest temperature of cDNA synthesis 1kb |
|---|---|---|---|---|---|---|---|---|
| N479E | | 2.58 | 17~ ~~~ | ~~ ~~ | | | | 45.5°C |
| H594R | 4 (5) | 2.67 | 18 | | | | 129 % | 47.8°C |
| H594K | | 3.66 | 270 000 | 80 % | 9 % | 170 | 94 % | 47.8-50.4°C |
| H594Q | 1 (5) | 3.85 | 231 000 | 75 % | 13 % | | | 47.8-50.4°C |
| H594N | | 4.15 | 216 000 | 61 % | 11 % | | | 47.8°C |
| D449G | 2 (3) | 3.53 | 123 000 | 79 % | 13 % | 162 | 90 % | 45.5-47.8°C |
| M-MuLV (wt) | | 3.4 | ~200 000 | 45-50 % | 11 % | ~160-200 | 100 % | 47.8°C |
| D449E | | 3.25 | 224 000 | 77 % | | | | 45.5°C |
| D449N | | 3.25 | 221 000 | 75 % | | | | 45.5°C |
| D449A | 1 (3) | 4.15 | 212 000 | 99 % | | | | 45.5-47.8°C |
| D449V | | 4.45 | 216 000 | 83 % | | | | 45.5°C |
| M39V | 1 (2) | 3.09 | 146 000 | 54 % | 13 % | 150 | 83 % | 45.5-47.8°C |
| M39L | 1 (2) | 2.24 | 212 000 | 47 % | 9 % | | | 45.5°C |
| M39F | | 2.51 | 141 000 | 43 % | 8 % | | | 45.5°C |
| M39N | | 2.38 | 349 000 | 71 % | 0 % | | | 45.5-47.8°C |
| M66L | 1 (2) | 3.35 | 237 000 | 79 % | 13 % | 215 | 119 % | 47.8°C |
| M66V | 1 (2) | 2.75 | 227 000 | 73 % | | | | 45.5-47.8°C |
| M66I | | 3.27 | 240 000 | 80 % | | | | 45.5-47.8°C |
| L333Q | 3 (4) | 3.34 | 177 000 | 54 % | 9 % | 233 | 129 % | 47.8°C |
| H126R | 2 (4) | 3.58 | 227 000 | 58 % | 4 % | 218 | 121 % | 47.8°C |
| Y344H | 3 (3) | 3.29 | 85 000 | 30 % | 13 % | 117 | 65 % | 45.5°C |
| P130S | 3 (3) | 2.59 | 120 000 | 70 % | 10 % | 156 | 87 % | 47.8°C |
| Q91R | 1 (2) | 2.44 | 160 000 | 56 % | 13 % | 162 | 90 % | 47.8°C |
| N649S | 3 (3) | 3.47 | 157 000 | 45 % | 16 % | | | 47.8°C |
| W388R | 2 (2) | 1.75 | 266 000 | 72 % | 14 % | | | 45.5-47.8°C |
| R390W | 2 (2) | 1.98 | 161 000 | 64 % | 10 % | | | 45.5-47.8°C |
| I179V | 1 (2) | 5.44 | 251 000 | 52 % | | | | 48°C |
| Q374R | 2 (2) | 3.17 | 135 000 | 56 % | 9 % | | | |
| E5K | 2 (2) | 3.2 | 160 000 | 67 % | 5 % | | | |

APPENDIX 6

| | Conc., | Specific activity | | Highest temperature of cDNA synthesis | |
|---|---|---|---|---|---|
| | mg/ml | 37°C (u/mg) | 50°C | 1kb | 4.5kb |
| M-MuLV (wt) | 3,4 | ~200 000 | 45 - 50 % | 47,8°C | |
| D200N, L603W (20 mut.) | 0.46 | 260 000 | 131 % | 56°C | |
| D200N, L603W, T330P (M0_1) | 4,17 | 321 194 | 175 % | 56-58°C | 53°C |
| D200N, L603W, T330P, E607K (M1) | 4,27 | 311 576 | 174 % | 60-62°C | 56°C |
| D200N, L603W, T330P, E607K, L139P (M2) | 2,91 | 348 694 | 176 % | 62°C | 61°C |
| D200N, L603W, N479D, H594R (M3) | 5,37 | 371 510 | 182 % | 56-58°C | 56°C |
| D200N, L603W, D653N, D524G (M4) | 4,84 | 358 112 | 155 % | 58-60°C | 58°C |
| D200N, L603W, D653N, D524G, T330P (M6) | 5,23 | 272 031 | 180 % | 60-62°C | 58°C |

APPENDIX 7

SEQ ID No: 1

```
LOCUS      pET-his-MLV-pD      7873 bp   DNA   circular   5-JUN-2007
SOURCE
 ORGANISM
COMMENT    This file is created by Vector NTI
           http://www.invitrogen.com/
COMMENT    ORIGDB|GenBank
COMMENT    VNTDATE|448383004|
COMMENT    VNTDBDATE|448383004|
COMMENT    LSOWNER|
COMMENT    VNTNAME|pET-his-MLV-pD|
COMMENT    VNTAUTHORNAME|Remigijus Skirgaila|
COMMENT    VNTAUTHORTEL|+370-5-2394224|
COMMENT    VNTAUTHOREML|skirgaila@fermentas.lt|
COMMENT    VNTAUTHORWWW|www.fermentas.com|
FEATURES          Location/Qualifiers
    CDS           3534..4391
                  /vntifkey="4"
                  /label=Ap
                  /note="ORF: Frame #2  Start: atg  Stop: taa"
    CDS           complement(6586..7674)
                  /vntifkey="4"
                  /label=lacI
                  /note="ORF: Frame #3  Start: gtg  Stop: tga"
    terminator    2864..2910
                  /vntifkey="43"
                  /label=T7\terminator
    rep_origin    2947..3402
                  /vntifkey="33"
                  /label=f1\origin
    rep_origin    complement(2936..2936)
                  /vntifkey="33"
                  /label=ori
    promoter      174..190
                  /vntifkey="30"
                  /label=PT7
    misc_feature  2394..2669
                  /vntifkey="21"
                  /label=pD
    misc_feature  2364..2393
                  /vntifkey="21"
                  /label=gs\linker
    misc_feature  2670..2759
                  /vntifkey="21"
                  /label=gs\linker
    misc_feature  306..2363
                  /vntifkey="21"
                  /label=MLV\H+
    misc_feature  258..305
                  /vntifkey="21"
                  /label=his
```

BASE COUNT    1873 a    2155 c    2084 g    1761 t
ORIGIN
       1 cacggggcct gccaccatac ccacgccgaa acaagcgctc atgagcccga agtggcgagc
      61 ccgatcttcc ccatcggtga tgtcggcgat ataggcgcca gcaaccgcac ctgtggcgcc
     121 ggtgatgccg gccacgatgc gtccggcgta gaggatcgag atctatacga aattaatacg
     181 actcactata gggagaccac aacggtttcc ctctagaaat aattttgttt aactttaaga
     241 aagaggagaa attacatatg agaggatcgc atcaccatca ccatcacgga tctggttcca
     301 tgggcatgac cctaaatata gaagatgagc atcggctaca tgagacctca aaagagccag
     361 atgtttctct agggtccaca tggctgtctg attttcctca ggcctgggcg gaaaccgggg
     421 gcatgggact ggcagttcgc caagctcctc tgatcatacc tctgaaagca acctctaccc
     481 ccgtgtccat aaaacaatac cccatgtcac aagaagccag actgggatc aagcccaca
     541 tacagagact gttggaccag ggaatactgg taccctgcca gtccccctgg aacacgcccc
     601 tgctacccgt taagaaacca gggactaatg attataggcc tgtccaggat ctgagagaag
     661 tcaacaagcg ggtggaagac atccacccca ccgtgcccaa cccttacaac ctcttgagcg
     721 ggctcccacc gtcccaccag tggtacactg tgcttgattt aaaggatgcc ttttctgcc
     781 tgagactcca ccccaccagt cagcctctct tcgcctttga gtggagagat ccagagatgg
     841 gaatctcagg acaattgacc tggaccagac tcccacaggg tttcaaaaac agtcccaccc
     901 tgtttgatga ggcactgcac agagacctag cagacttccg gatccagcac ccagacttga
     961 tcctgctaca gtacgtggat gacttactgc tggccgccac ttctgagcta gactgccaac
    1021 aaggtactcg ggccctgtta caaaccctag ggaacctcgg gtatcgggcc tcggccaaga
    1081 aagcccaaat ttgccagaaa caggtcaagt atctggggta tcttctaaaa gagggtcaga
    1141 gatggctgac tgaggccaga aaagagactg tgatggggca gcctactccg aagacccctc
    1201 gacaactaag ggagttccta gggacggcag gcttctgtcg cctctggatc cctgggtttg
    1261 cagaaatggc agccccccttg taccctctca ccaaaacggg gactctgttt aattggggcc
    1321 cagaccaaca aaaggcctat caagaaatca agcaagctct tctaactgcc ccagccctgg
    1381 ggttgccaga tttgactaag ccctttgaac tctttgtcga cgagaagcag ggctacgcca
    1441 aaggtgtcct aacgcaaaaa ctgggaccttt ggcgtcggcc ggtggcctac ctgccaaaa
    1501 agctagaccc agtagcagct gggtggcccc cttgcctacg gatggtagca gccattgccg
    1561 tactgacaaa ggatgcaggc aagctaacca tggacagcc actagtcatt ctggccccc
    1621 atgcagtaga ggcactagtc aaacaacccc ccgaccgctg gctttccaac gccggatga
    1681 ctcactatca ggccttgctt ttggacacgg accgggtcca gttcggaccg gtggtagccc
    1741 tgaacccggc tacgctgctc ccactgcctg aggaagggct gcaacacaac tgccttgata
    1801 tcctggccga agcccacgga acccgacccg acctaacgga ccagccgctc ccagacgccg
    1861 accacacctg gtacacggat ggaagcagtc tcttacaaga gggacagcgt aaggcgggag
    1921 ctgcggtgac caccgagacc gaggtaatct gggctaaagc cctgccagcc gggacatccg
    1981 ctcagcgggc tgaactgata gcactcaccc aggcctaaa gatggcagaa ggtaagaagc
    2041 taaatgttta tactgatagc cgttatgctt ttgctactgc ccatatccat ggagaaatat
    2101 acagaaggcg tgggttgctc acatcagaag gcaaagagat caaaaataaa gacgagatct
    2161 tggccctact aaaaagccctc tttctgccca aaagacttag cataatccat tgtccaggac
    2221 atcaaaaggg acacagcgcc gaggctagag gcaaccggat ggctgaccaa gcggccgaa
    2281 aggcagccat cacagagact ccagacacct ctaccctcct catagaaaat tcatcaccca
    2341 attcccgctt aattaatgaa ttcggatccg gtggcggttc cggcggtgga tctatgggta
    2401 ccgcaaccgc gcccggcgga ttgagtgcga aagcgcctgc aatgacccg ctgatgctgg
    2461 acacctccag ccgtaagctg gttgcgtggg atggcaccac cgacggtgct gccgttggca
    2521 ttcttgcggt tgctgctgac cagaccagca ccacgctgac gttctacaag tccggcacgt
    2581 tccgttatga ggatgtgctc tggccggagg ctgccagcga cgagacgaaa aacggaccg
    2641 cgtttgccgg aacggcaatc agcatcgttg gatctggtgg cggttccggc ggtggatctg
    2701 gtggcggttc cggcggtgga tctggtggcg gttccggcgg tggatcgtgt cttctttaag
    2761 cttgcgggcg cactcgagca ccaccaccac caccactgag atccgctgc taacaaagcc
    2821 cgaaaggaag ctgagttggc tgctgccacc gctgagcaat aactagcata accccttggg
    2881 gcctctaaac gggtcttgag ggttttttg ctgaaaggag gaactatatc cggattggcg
    2941 aatgggacgc gccctgtagc ggcgcattaa gcgcggcggg tgtggtggtt acgcgcagcg
    3001 tgaccgctac acttgccagc gccctagcgc ccgctccttt cgctttcttc ccttcctttc
    3061 tcgccacgtt cgccggcttt ccccgtcaag ctctaaatcg ggggctccct ttagggttcc 3121 gatttagtgc tttacggcac ctcgacccca aaaaacttga ttagggtgat ggttcacgta
3181 gtgggccatc gccctgatag acggttttc gcccttttgac gttggagtcc acgttcttta
3241 atagtggact cttgttccaa actggaacaa cactcaaccc tatctcggtc tattcttttg
3301 atttataagg gatttttgccg atttcggcct attggttaaa aaatgagctg atttaacaaa
3361 aatttaacgc gaattttaac aaaatattaa cgtttacaat ttcaggtggc actttttcggg
3421 gaaatgtgcg cggaacccct atttgtttat ttttctaaat acattcaaat atgtatccgc
3481 tcatgagaca ataacccctga taaatgcttc aataatattg aaaaaggaag agtatgagta
3541 ttcaacattt ccgtgtcgcc cttattccct tttttgcggc attttgcctt cctgttttg
3601 ctcacccaga aacgctggtg aaagtaaaag atgctgaaga tcagttgggt gcacgagtgg
3661 gttacatcga actggatctc aacagcggta agatccttga gagttttcgc cccgaagaac
3721 gttttccaat gatgagcact tttaaagttc tgctatgtgg cgcggtatta tcccgtattg
3781 acgccgggca agagcaactc ggtcgccgca tacactattc tcagaatgac ttggttgagt
3841 actcaccagt cacagaaaag catcttacgg atggcatgac agtaagagaa ttatgcagtg
3901 ctgccataac catgagtgat aacactgcgg ccaacttact tctgacaacg atcggaggac
3961 cgaaggagct aaccgctttt ttgcacaaca tgggggatca tgtaactcgc cttgatcgtt
4021 gggaaccgga gctgaatgaa gccataccaa acgacgagcg tgacaccacg atgcctgcag
4081 caatggcaac aacgttgcgc aaactattaa ctggcgaact acttactcta gcttcccggc
4141 aacaattaat agactggatg gaggcggata aagttgcagg accacttctg cgctcggccc
4201 ttccggctgg ctgtttatt gctgataaat ctggagccgg tgagcgtggg tctcgcggta
4261 tcattgcagc actggggcca gatggtaagc cctcccgtat cgtagttatc tacacgacgg
4321 ggagtcaggc aactatggat gaacgaaata gacagatcgc tgagataggt gcctcactga
4381 ttaagcattg gtaactgtca gaccaagttt actcatatat actttagatt gatttaaaac
4441 ttcatttta atttaaaagg atctaggtga agatccttt tgataatctc atgaccaaaa
4501 tcccttaacg tgagttttcg ttccactgag cgtcagaccc cgtagaaaag atcaaaggat
4561 cttcttgaga tccttttttt ctgcgcgtaa tctgctgctt gcaaacaaaa aaaccaccgc
4621 taccagcggt ggtttgtttg ccggatcaag agctaccaac tcttttccg aaggtaactg
4681 gcttcagcag agcgcagata ccaaatactg tccttctagt gtagccgtag ttaggccacc
4741 acttcaagaa ctctgtagca ccgcctacat acctcgctct gctaatcctg ttaccagtgg
4801 ctgctgccag tggcgataag tcgtgtctta ccgggttgga ctcaagacga tagttaccgg
4861 ataaggcgca gcggtcgggc tgaacggggg gttcgtgcac acagcccagc ttggagcgaa
4921 cgacctacac cgaactgaga tacctacagc gtgagctatg agaaagcgcc acgcttcccg
4981 aagggagaaa ggcggacagg tatccggtaa gcggcagggt cggaacagga gagcgcacga
5041 gggagcttcc agggggaaac gcctggtatc tttatagtcc tgtcgggttt cgccacctct
5101 gacttgagcg tcgatttttg tgatgctcgt caggggggcg gagcctatgg aaaaacgcca
5161 gcaacgcggc cttttacgg ttcctggcct tttgctggcc ttttgctcac atgttctttc
5221 ctgcgttatc ccctgattct gtggataacc gtattaccgc ctttgagtga gctgataccg
5281 ctcgccgcag ccgaacgacc gagcgcagcg agtcagtgag cgaggaagcg gaagagcgcc
5341 tgatgcggta ttttctcctt acgcatctgt gcggtatttc acaccgcata tatggtgcac
5401 tctcagtaca atctgctctg atgccgcata gttaagccag tatacactcc gctatcgcta
5461 cgtgactggg tcatggctgc gccccgacac ccgccaacac ccgctgacgc gccctgacgg
5521 gcttgtctgc tcccggcatc cgcttacaga caagctgtga ccgtctccgg gagctgcatg
5581 tgtcagaggt tttcaccgtc atcaccgaaa cgcgcgaggc agctgcggta aagctcatca
5641 gcgtggtcgt gaagcgattc acagatgtct gcctgttcat ccgcgtccag ctcgttgagt
5701 ttctccagaa gcgttaatgt ctggcttctg ataaagcggg ccatgttaag ggcggttttt
5761 tcctgtttgg tcactgatgc ctccgtgtaa gggggatttc tgttcatggg ggtaatgata
5821 ccgatgaaac gagagaggat gctcacgata cgggttactg atgatgaaca tgcccggtta
5881 ctggaacgtt gtgagggtaa acaactggcg gtatggatgc ggcgggacca gagaaaaatc
5941 actcagggtc aatgccagcg cttcgttaat acagatgtag gtgttccaca gggtagccag
6001 cagcatcctg cgatgcagat ccggaacata atggtgcagg gcgctgactt ccgcgtttcc
6061 agactttacg aaacacggaa accgaagacc attcatgttg ttgctcaggt cgcagacgtt
6121 ttgcagcagc agtcgcttca cgttcgctcg cgtatcggtg attcattctg ctaaccagta
6181 aggcaacccc gccagcctag ccgggtcctc aacgacagga gcacgatcat gcgcacccgt
6241 ggggccgcca tgccggcgat aatggcctgc ttctcgccga aacgtttggt ggcgggacca
6301 gtgacgaagg cttgagcgag ggcgtgcaag attccgaata ccgcaagcga caggccgatc

```
6361 atcgtcgcgc tccagcgaaa gcggtcctcg ccgaaaatga cccagagcgc tgccggcacc
6421 tgtcctacga gttgcatgat aaagaagaca gtcataagtg cggcgacgat agtcatgccc
6481 cgcgcccacc ggaaggagct gactgggttg aaggctctca agggcatcgg tcgagatccc
6541 ggtgcctaat gagtgagcta acttacatta attgcgttgc gctcactgcc cgcttccag
6601 tcgggaaacc tgtcgtgcca gctgcattaa tgaatcggcc aacgcgcggg gagaggcggt
6661 ttgcgtattg ggcgccaggg tggtttttct tttcaccagt gagacgggca acagctgatt
6721 gcccttcacc gcctggccct gagagagttg cagcaagcgg tccacgctgg tttgccccag
6781 caggcgaaaa tcctgtttga tggtggttaa cggcgggata acatgagc tgtcttcggt
6841 atcgtcgtat cccactaccg agatatccgc accaacgcgc agcccggact cggtaatggc
6901 gcgcattgcg cccagcgcca tctgatcgtt ggcaaccagc atcgcagtgg gaacgatgcc
6961 ctcattcagc atttgcatgg tttgttgaaa accggacatg gcactccagt cgccttcccg
7021 ttccgctatc ggctgaattt gattgcgagt gagatattta tgccagccag ccagacgcag
7081 acgcgccgag acagaactta atgggcccgc taacagcgcg atttgctggt gacccaatgc
7141 gaccagatgc tccacgccca gtcgcgtacc gtcttcatgg gagaaaataa tactgttgat
7201 gggtgtctgg tcagagacat caagaaataa cgccggaaca ttagtgcagg cagcttccac
7261 agcaatggca tcctggtcat ccagcggata gttaatgatc agcccactga cgcgttgcgc
7321 gagaagattg tgcaccgccg ctttacaggc ttcgacgccg cttcgttcta ccatcgacac
7381 caccacgctg gcacccagtt gatcggcgcg agatttaatc gccgcgacaa tttgcgacgg
7441 cgcgtgcagg gccagactgg aggtggcaac gccaatcagc aacgactgtt tgcccgccag
7501 ttgttgtgcc acgcggttgg gaatgtaatt cagctccgcc atcgccgctt ccacttttc
7561 ccgcgttttc gcagaaacgt ggctggcctg gttcaccacg cgggaaacgg tctgataaga
7621 gacaccggca tactctgcga catcgtataa cgttactggt ttcacattca ccaccctgaa
7681 ttgactctct tccgggcgct atcatgccat accgcgaaag gttttgcgcc attcgatggt
7741 gtccgggatc tcgacgctct cccttatgcg actcctgcat taggaagcag cccagtagta
7801 ggttgaggcc gttgagcacc gccgccgcaa ggaatggtgc atgcaaggag atggcgccca
7861 acagtccccc ggc
```

SEQ ID No: 2

LOCUS    pET_his_del_pD    7702 bp   DNA   circular   6-JUN-2007
SOURCE
 ORGANISM
COMMENT   This file is created by Vector NTI
       http://www.invitrogen.com/
COMMENT   VNTDATE|448455242|
COMMENT   VNTDBDATE|448455855|
COMMENT   LSOWNER|
COMMENT   VNTNAME|pET_his_del_pD|
COMMENT   VNTAUTHORNAME|Remigijus Skirgaila|
COMMENT   VNTAUTHORTEL|+370-5-2394224|
COMMENT   VNTAUTHOREML|skirgaila@fermentas.lt|
COMMENT   VNTAUTHORWWW|www.fermentas.com|
FEATURES         Location/Qualifiers
    misc_feature   2499..2588
         /vntifkey="21"
         /label=gs\linker
    misc_feature   2193..2222
         /vntifkey="21"
         /label=gs\linker
    misc_feature   2223..2498
         /vntifkey="21"
         /label=pD
    promoter      174..190

```
            /vntifkey="30"
            /label=PT7
rep_origin    complement(2765..2765)
            /vntifkey="33"
            /label=ori
rep_origin    2776..3231
            /vntifkey="33"
            /label=f1\origin
terminator    2693..2739
            /vntifkey="43"
            /label=T7\terminator
CDS           complement(6415..7503)
            /vntifkey="4"
            /label=lacI
            /note="ORF: Frame #3  Start: gtg  Stop: tga"
CDS           3363..4220
            /vntifkey="4"
            /label=Ap
            /note="ORF: Frame #2  Start: atg  Stop: taa"
misc_feature  258..305
            /vntifkey="21"
            /label=his
misc_feature  306..2192
            /vntifkey="21"
            /label=del
BASE COUNT    1823 a    2115 c    2033 g    1731 t
ORIGIN
    1 cacggggcct gccaccatac ccacgccgaa acaagcgctc atgagcccga agtggcgagc
   61 ccgatcttcc ccatcggtga tgtcggcgat ataggcgcca gcaaccgcac ctgtggcgcc
  121 ggtgatgccg gccacgatgc gtccggcgta gaggatcgag atctatacga aattaatacg
  181 actcactata gggagaccac aacggtttcc ctctagaaat aattttgttt aactttaaga
  241 aagaggagaa attacatatg agaggatcgc atcaccatca ccatcacgga tctggttcca
  301 tgggcatgac cctaaatata gaagatgagc atcggctaca tgagacctca aaagagccag
  361 atgtttctct agggtccaca tggctgtctg attttcctca ggcctgggcg gaaaccgggg
  421 gcatgggact ggcagttcgc caagctcctc tgatcatacc tctgaaagca acctctaccc
  481 ccgtgtccat aaaacaatac cccatgtcac aagaagccag actggggatc aagccccaca
  541 tacagagact gttggaccag ggaatactgg taccctgcca gtcccctgg aacacgcccc
  601 tgctacccgt taagaaacca gggactaatg attataggcc tgtccaggat ctgagagaag
  661 tcaacaagcg ggtggaagac atccaccca ccgtgcccaa cccttacaac ctcttgagcg
  721 ggctcccacc gtcccaccag tggtacactg tgcttgattt aaaggatgcc tttttctgcc
  781 tgagactcca ccccaccagt cagcctctct tcgcctttga gtggagagat ccagagatgg
  841 gaatctcagg acaattgacc tggaccagac tcccacaggg tttcaaaaac agtcccaccc
  901 tgtttgatga ggcactgcac agagacctag cagacttccg gatccagcac ccagacttga
  961 tcctgctaca gtacgtggat gacttactgc tggccgccac ttctgagcta gactgccaac
 1021 aaggtactcg ggccctgtta caaacccag ggacggcagg cttctgtcgc ctctggatcc
 1081 ctgggtttgc agaaatggca gcccccttgt accctctcac caaaacgggg actctgttta
 1141 attgggccc agaccaacaa aaggcctatc aagaaatcaa gcaagctctt ctaactgccc
 1201 cagccctggg gttgccagat ttgactaagc cctttgaact ctttgtcgac gagaagcagg
 1261 gctacgccaa aggtgtccta acgcaaaaac tgggaccttg gcgtcggccg gtggcctacc
 1321 tgtccaaaaa gctagaccca gtagcagctg ggtggccccc ttcctacgg atggtagcag
 1381 ccattgccgt actgacaaag gatgcaggca gctaaccat gggacagcca ctagtcattc
 1441 tggcccccca tgcagtagag gcactagtca aacaacccc cgaccgctgg ctttccaacg
 1501 cccggatgac tcactatcag gccttgcttt tggacacgga ccgggtccag ttcggaccgg
 1561 tggtagccct gaacccggct acgctgctcc cactgcctga ggaagggctg caacacaact
```

```
1621 gccttgatat cctggccgaa-gcccacggaa cccgacccga cctaacggac cagccgctcc
1681 cagacgccga ccacacctgg tacacggatg gaagcagtct cttacaagag ggacagcgta
1741 aggcgggagc tgcggtgacc accgagaccg aggtaatctg ggctaaagcc ctgccagccg
1801 ggacatccgc tcagcgggct gaactgatag cactcaccca ggccctaaag atggcagaag
1861 gtaagaagct aaatgtttat actaatagcc gttatgcttt tgctactgcc catatccatg
1921 gagaaatata cagaaggcgt gggttgctca catcagaagg caaagagatc aaaaataaag
1981 acgagatctt ggccctacta aaagccctct ttctgcccaa aagacttagc ataatccatt
2041 gtccaggaca tcaaaaggga cacagcgccg aggctagagg caaccggatg gctgaccaag
2101 cggcccgaaa ggcagccatc acagagactc cagacacctc taccctcctc atagaaaatt
2161 catcacccaa ttcccgctta attaatgaat tcggatccgg tggcggttcc ggcggtggat
2221 ctatgggtac cgcaaccgcg cccggcggat tgagtgcgaa agcgcctgca atgacccccgc
2281 tgatgctgga cacctccagc cgtaagctgg ttgcgtggga tggcaccacc gacggtgctg
2341 ccgttggcat tcttgcggtt gctgctgacc agaccagcac cacgctgacg ttctacaagt
2401 ccggcacgtt ccgttatgag gatgtgctct ggccggaggc tgccagcgac gagacgaaaa
2461 aacggaccgc gtttgccgga acggcaatca gcatcgttgg atctggtggc ggttccggcg
2521 gtggatctgg tgcggttcc ggcggtggat ctggtggcgg ttccggcggt ggatcgtgtc
2581 ttctttaagc ttgcggccgc actcgagcac caccaccacc accactgaga tccggctgct
2641 aacaaagccc gaaaggaagc tgagttggct gctgccaccg ctgagcaata actagcataa
2701 cccctttgggg cctctaaacg ggtcttgagg ggtttttgc tgaaaggagg aactatatcc
2761 ggattggcga atgggacgcg ccctgtagcg gcgcattaag cgcggcgggt gtggtggtta
2821 cgcgcagcgt gaccgctaca cttgccagcg ccctagcgcc cgctcctttc gctttcttcc
2881 cttcctttct cgccacgttc gccggctttc cccgtcaagc tctaaatcgg gggctccctt
2941 tagggttccg atttagtgct ttacggcacc tcgaccccaa aaaacttgat tagggtgatg
3001 gttcacgtag tgggccatcg ccctgataga cggtttttcg ccctttgacg ttggagtcca
3061 cgttctttaa tagtggactc ttgttccaaa ctggaacaac actcaaccct atctcggtct
3121 attctttga tttataaggg atttgccga tttcggccta ttggttaaaa aatgagctga
3181 tttaacaaaa atttaacgcg aattttaaca aaatattaac gtttacaatt tcaggtggca
3241 cttttcgggg aaatgtgcgc ggaacccta tttgtttatt tttctaaata cattcaaata
3301 tgtatccgct catgagacaa taaccctgat aaatgcttca ataatattga aaaaggaaga
3361 gtatgagtat tcaacatttc cgtgtcgccc ttattccctt ttttgcggca ttttgccttc
3421 ctgtttttgc tcacccagaa acgctggtga aagtaaaaga tgctgaagat cagttgggtg
3481 cacgagtggg ttacatcgaa ctggatctca acagcggtaa gatccttgag agttttcgcc
3541 ccgaagaacg ttttccaatg atgagcactt ttaaagttct gctatgtggc gcggtattat
3601 cccgtattga cgccgggcaa gagcaactcg gtcgccgcat acactattct cagaatgact
3661 tggttgagta ctcaccagtc acagaaaagc atcttacgga tggcatgaca gtaagagaat
3721 tatgcagtgc tgccataacc atgagtgata acactgcggc caacttactt ctgacaacga
3781 tcggaggacc gaaggagcta accgcttttt tgcacaacat gggggatcat gtaactcgcc
3841 ttgatcgttg ggaaccggag ctgaatgaag ccataccaaa cgacgagcgt gacaccacga
3901 tgcctgcagc aatggcaaca acgttgcgca aactattaac tggcgaacta cttactctag
3961 cttcccggca acaattaata gactggatgg aggcggataa agttgcagga ccacttctgc
4021 gctcggccct tccggctggc tggtttattg ctgataaatc tggagccggt gagcgtgggt
4081 ctcgcggtat cattgcagca ctggggccag atggtaagcc ctcccgtatc gtagttatct
4141 acacgacggg gagtcaggca actatggatg aacgaaatag acagatcgct gagataggtg
4201 cctcactgat taagcattgg taactgtcag accaagttta ctcatatata ctttagattg
4261 atttaaaact tcatttttaa tttaaaagga tctaggtgaa gatccttttt gataatctca
4321 tgaccaaaat cccttaacgt gagttttcgt tccactgagc gtcagacccc gtagaaaaga
4381 tcaaaggatc ttcttgagat cctttttttc tgcgcgtaat ctgctgcttg caaacaaaaa
4441 aaccaccgct accagcggtg gtttgtttgc cggatcaaga gctaccaact ctttttccga
4501 aggtaactgg cttcagcaga gcgcagatac caaatactgt ccttctagtg tagccgtagt
4561 taggccacca cttcaagaac tctgtagcac cgcctacata cctcgctctg ctaatcctgt
4621 taccagtggc tgctgccagt ggcgataagt cgtgtcttac cgggttggac tcaagacgat
4681 agttaccgga taaggcgcag cggtcgggct gaacggggg ttcgtgcaca gcccagct
4741 tggagcgaac gacctacacc gaactgagat acctacagcg tgagctatga gaaagcgcca
4801 cgcttcccga agggagaaag gcggacaggt atccggtaag cggcagggtc ggaacaggag
```

```
4861 agcgcacgag ggagcttcca gggggaaacg cctggtatct ttatagtcct gtcgggtttc
4921 gccacctctg acttgagcgt cgatttttgt gatgctcgtc aggggggcgg agcctatgga
4981 aaaacgccag caacgcggcc tttttacggt tcctggcctt ttgctggcct tttgctcaca
5041 tgttctttcc tgcgttatcc cctgattctg tggataaccg tattaccgcc tttgagtgag
5101 ctgataccgc tcgccgcagc cgaacgaccg agcgcagcga gtcagtgagc gaggaagcgg
5161 aagagcgcct gatgcggtat tttctcctta cgcatctgtg cggtatttca caccgcatat
5221 atggtgcact ctcagtacaa tctgctctga tgccgcatag ttaagccagt atacactccg
5281 ctatcgctac gtgactgggt catggctgcg ccccgacacc cgccaacacc cgctgacgcg
5341 ccctgacggg cttgtctgct cccggcatcc gcttacagac aagctgtgac cgtctccggg
5401 agctgcatgt gtcagaggtt ttcaccgtca tcaccgaaac gcgcgaggca gctgcggtaa
5461 agctcatcag cgtggtcgtg aagcgattca cagatgtctg cctgttcatc cgcgtccagc
5521 tcgttgagtt tctccagaag cgttaatgtc tggcttctga taaagcgggc catgttaagg
5581 gcggtttttt cctgtttggt cactgatgcc tccgtgtaag ggggatttct gttcatgggg
5641 gtaatgatac cgatgaaacg agagaggatg ctcacgatac gggttactga tgatgaacat
5701 gcccggttac tggaacgttg tgagggtaaa caactggcgg tatggatgcg gcgggaccag
5761 agaaaaatca ctcagggtca atgccagcgc ttcgttaata cagatgtagg tgttccacag
5821 ggtagccagc agcatcctgc gatgcagatc cggaacataa tggtgcaggg cgctgacttc
5881 cgcgtttcca gactttacga aacacggaaa ccgaagacca ttcatgttgt tgctcaggtc
5941 gcagacgttt tgcagcagca gtcgcttcac gttcgctcgc gtatcggtga ttcattctgc
6001 taaccagtaa ggcaaccccg ccagcctagc cgggtcctca acgacaggag cacgatcatg
6061 cgcacccgtg gggccgccat gccggcgata atggcctgct tctcgccgaa acgtttggtg
6121 gcgggaccag tgacgaaggc ttgagcgagg gcgtgcaaga ttccgaatac cgcaagcgac
6181 aggccgatca tcgtcgcgct ccagcgaaag cggtcctcgc cgaaaatgac ccagagcgct
6241 gccggcacct gtcctacgag ttgcatgata agaagacag tcataagtgc ggcgacgata
6301 gtcatgcccc gcgcccaccg gaaggagctg actgggttga aggctctcaa gggcatcggt
6361 cgagatcccg gtgcctaatg agtgagctaa cttacattaa ttgcgttgcg ctcactgccc
6421 gctttccagt cgggaaacct gtcgtgccag ctgcattaat gaatcggcca acgcgcgggg
6481 agaggcggtt tgcgtattgg gcgccagggt ggtttttctt ttcaccagtg agacgggcaa
6541 cagctgattg cccttcaccg cctggccctg agagagttgc agcaagcggt ccacgctggt
6601 ttgccccagc aggcgaaaat cctgtttgat ggtggttaac ggcgggatat aacatgagct
6661 gtcttcggta tcgtcgtatc ccactaccga gatatccgca ccaacgcgca gcccggactc
6721 ggtaatggcg cgcattgcgc ccagcgccat ctgatcgttg caaccagca tcgcagtggg
6781 aacgatgccc tcattcagca tttgcatggt ttgttgaaaa ccggacatgg cactccagtc
6841 gccttcccgt tccgctatcg gctgaatttg attgcgagtg agatatttat gccagccagc
6901 cagacgcaga cgcgccgaga cagaacttaa tgggcccgct aacagcgcga tttgctggtg
6961 acccaatgcg accagatgct ccacgcccag tcgcgtaccg tcttcatggg agaaaataat
7021 actgttgatg ggtgtctggt cagagacatc aagaaataac gccggaacat tagtgcaggc
7081 agcttccaca gcaatggcat cctggtcatc cagcggatag ttaatgatca gcccactgac
7141 gcgttgcgcg agaagattgt gcaccgccgc tttacaggct tcgacgccgc ttcgttctac
7201 catcgacacc accacgctgg cacccagttg atcggcgcga gatttaatcg ccgcgacaat
7261 ttgcgacggc gcgtgcaggg ccagactgga ggtggcaacg ccaatcagca acgactgttt
7321 gcccgccagt tgttgtgcca cgcggttggg aatgtaattc agctccgcca tcgccgcttc
7381 cactttttcc cgcgttttcg cagaaacgtg gctggcctgg ttcaccacgc gggaaacggt
7441 ctgataagag acaccggcat actctgcgac atcgtataac gttactggtt tcacattcac
7501 caccctgaat tgactctctt ccgggcgcta tcatgccata ccgcgaaagg ttttgcgcca
7561 ttcgatggtg tccgggatct cgacgctctc ccttatgcga ctcctgcatt aggaagcagc
7621 ccagtagtag gttgaggccg ttgagcaccg ccgccgcaag gaatggtgca tgcaaggaga
7681 tggcgcccaa cagtcccccg gc
```

SEQ ID No: 3 oligonucleotide (22 b)
pro-pIVEX

5'-GCGAGCCCGATCTTCCCCATCG-3'

SEQ ID No: 4 oligonucleotide (21 b)
pD-ter
5'-AAGAAGACACGATCCACCGCC-3'

SEQ ID No: 5
oligonucleotide (38 b)
assrA
5'-TTAAGCTGCTAAAGCGTAGTTTTCGTCGTTTGCGACTA-3'

SEQ ID No: 6 protein (833 aa)
MLV_pD
mrgshhhhhhgsgsmgmtlniedehrlhetskepdvslgstwlsdfpqawaetggmglavrqapliiplkatstpvsikqypmsqearlgikphiq
rlldqgilvpcqspwntpllpvkkpgtndyrpvqdlrevnkrvedihptvpnpynllsglppshqwytvldlkdaffclrlhptsqplfafewrdpemgis
gqltwtrlpqgfknsptlfdealhrdladfriqhpdlillqyvddlllaatseldcqqgtrallqtlgnlgyrasakkaqicqkqvkylgyllkegqrwltearket
vmgqptpktprqlreflgtaglfcrlwipgfaemaaplyplktgtlfnwgpdqqkayqeikqailtapalglpdltkpfelfvdekqgyakgvltqklgpwr
rpvaylskkldpvaagwppclrmvaaiavltkdagkltmgqplvilaphavealvkqppdrwlsnarmthyqallldtdrvqfgpvvalnpatllplpe
eglqhncldilaeahgtrpdltdqplpdadhtwytdgsslIqegqrkagaavttetevlwakalpagtsaqraellaltqalkmaegkklnvytdsryaf
atahihgelyrrglltsegkelknkdeilallkalflpkrlsihcpghqkghsaeargnrmadqaarkaaltetpdtstllIiensspnsrlinefgsgggsg
ggsmgtatapgglsakapamtplmldtssrklvawdgttdgaavgilavaadqtstlltfyksgtfryedvlwpeaasdetkkrtafagtaisivgsgg
gsgggsgggsgggsgggsgggscll SEQ ID No: 7 protein (766 aa)
del_pD
mrgshhhhhhgsgsmgmtlniedehrlhetskepdvslgstwlsdfpqawaetggmglavrqapliiplkatstpvsikqypmsqearlgikphiq
rlldqgilvpcqspwntpllpvkkpgtndyrpvqdlrevnkrvedihptvpnpynllsglppshqwytvldlkdaffclrlhptsqplfafewrdpemgis
gqltwtrlpqgfknsptlfdealhrdladfriqhpdlillqyvddlllaatseldcqqgtrallqtlgtagfcrlwipgfaemaaplyplktgtlfnwgpdqqkay
qeikqailtapalglpdltkpfelfvdekqgyakgvltqklgpwrrpvaylskkldpvaagwppclrmvaaiavltkdagkltmgqplvilaphavealv
kqppdrwlsnarmthyqallldtdrvqfgpvvalnpatllplpeeglqhncldilaeahgtrpdltdqplpdadhtwytdgsslIqegqrkagaavttete
viwakalpagtsaqraellaltqalkmaegkklnvytdsryafatahihgelyrrglltsegkelknkdeilallkalflpkrlsihcpghqkghsaeargn
rmadqaarkaaltetpdtstllIiensspnsrlinefgsgggsgggsmgtatapgglsakapamtplmldtssrklvawdgttdgaavgilavaadqts
tlltfyksgtfryedvlwpeaasdetkkrtafagtaisivgsgggsgggsgggsgggsgggsgggscll SEQ ID No: 8 oligonucleotide (15 b)
pD_42
5'-TTACGGCTGGAGGTG-3'

SEQ ID No: 9 oligonucleotide (28 b)
RD_Nde
5'- CTTTAAGAAAGAGGAGAAATTACATATG-3'

SEQ ID No: 10 oligonucleotide (14 b)
pD_55
5'-GCCGGGCGCGGTTG-3'

SEQ ID No: 11
oligonucleotide (23 b)
M_F
5'-GATCAAGCCCCACATACAGAGAC-3'

SEQ ID No: 12 oligonucleotide (19 b)
M_2R
5'-GCCCTGCTTCTCGTCGACA-3'

SEQ ID No: 13 oligonucleotide (40 b)
M_Esp
5'-ATCGTCTCCCATGGGCATGACCCTAAATATAGAAGATGAG-3'

SEQ ID No: 14 oligonucleotide (32 b)
M_Eri
5'-AATGAATTCATTAATTAAGCGGGAATTGGGTG-3'

SEQ ID No: 15 oligonucleotide (18 b)
M_1R
5'-CAGGGCCCGAGTACCTTG-3'

SEQ ID No: 16 oligonucleotide (17 b)
M_3F
5'-CCAGTTCGGACCGGTGG-3'

SEQ ID No: 17 oligonucleotide (19 b)
pD_ter-
5'-AAGAAGACACGATCCACCG-3'

SEQ ID No: 18 oligonucleotide (36 b)
M_Hind3+

5'-CGGATCAAGCTTAATTAATTAAGCGGGAATTGGGTG-3'

SEQ ID No: 19

```
LOCUS      pET_his_MLV      7474 bp    DNA    circular    4-JUN-2007
SOURCE
  ORGANISM
COMMENT    This file is created by Vector NTI
           http://www.invitrogen.com/
COMMENT    ORIGDB|GenBank
COMMENT    VNTDATE|446486240|
COMMENT    VNTDBDATE|448293778|
COMMENT    LSOWNER|
COMMENT    VNTNAME|pET_his_MLV|
COMMENT    VNTAUTHORNAME|Remigijus Skirgaila|
COMMENT    VNTAUTHORTEL|+370-5-2394224|
COMMENT    VNTAUTHOREML|skirgaila@fermentas.lt|
COMMENT    VNTAUTHORWWW|www.fermentas.com|
FEATURES           Location/Qualifiers
     CDS           3135..3992
                   /vntifkey="4"
                   /label=Ap
                   /note="ORF: Frame #2  Start: atg  Stop: taa"
     CDS           complement(6187..7275)
                   /vntifkey="4"
                   /label=lacI
                   /note="ORF: Frame #3  Start: gtg  Stop: tga"
     terminator    2465..2511
                   /vntifkey="43"
                   /label=T7\terminator
     rep_origin    2548..3003
                   /vntifkey="33"
                   /label=f1\origin
     rep_origin    complement(2537..2537)
                   /vntifkey="33"
                   /label=ori
     promoter      174..190
                   /vntifkey="30"
                   /label=PT7
     CDS           306..2360
                   /vntifkey="4"
                   /label=MLV
     CDS           258..305
                   /vntifkey="4"
                   /label=his
BASE COUNT   1810 a   2046 c   1942 g   1676 t
ORIGIN
    1 cacggggcct gccaccatac ccacgccgaa acaagcgctc atgagcccga agtggcgagc
   61 ccgatcttcc ccatcggtga tgtcggcgat ataggcgcca gcaaccgcac ctgtggcgcc
  121 ggtgatgccg gccacgatgc gtccggcgta gaggatcgag atctatacga aattaatacg
  181 actcactata gggagaccac aacggtttcc ctctagaaat aattttgttt aactttaaga
  241 aagaggagaa attacatatg agaggatcgc atcaccatca ccatcacgga tctggttcca
```

```
 301 tgggcatgac cctaaatata gaagatgagc atcggctaca tgagacctca aaagagccag
 361 atgtttctct agggtccaca tggctgtctg attttcctca ggcctgggcg gaaaccgggg
 421 gcatgggact ggcagttcgc caagctcctc tgatcatacc tctgaaagca acctctaccc
 481 ccgtgtccat aaaacaatac cccatgtcac aagaagccag actggggatc aagcccaca
 541 tacagagact gttggaccag ggaatactgg taccctgcca gtcccctgg aacacgcccc
 601 tgctacccgt taagaaacca gggactaatg attataggcc tgtccaggat ctgagagaag
 661 tcaacaagcg ggtggaagac atccacccca ccgtgcccaa cccttacaac ctcttgagcg
 721 ggctcccacc gtcccaccag tggtacactg tgcttgattt aaaggatgcc ttttctgcc
 781 tgagactcca ccccaccagt cagcctctct tcgcctttga gtggagagat ccagagatgg
 841 gaatctcagg acaattgacc tggaccagac tcccacaggg tttcaaaaac agtcccaccc
 901 tgtttgatga ggcactgcac agagacctag cagacttccg gatccagcac ccagacttga
 961 tcctgctaca gtacgtggat gacttactgc tggccgccac ttctgagcta gactgccaac
1021 aaggtactcg ggccctgtta caaaccctag ggaacctcgg gtatcgggcc tcggccaaga
1081 aagcccaaat ttgccagaaa caggtcaagt atctggggta tcttctaaaa gagggtcaga
1141 gatggctgac tgaggccaga aaagagactg tgatggggca gcctactccg aagccccctc
1201 gacaactaag ggagttccta gggacggcag gcttctgtcg cctctggatc cctgggtttg
1261 cagaaatggc agccccttg taccctctca ccaaaacggg gactctgttt aattggggcc
1321 cagaccaaca aaaggcctat caagaaatca agcaagctct tctaactgcc ccagccctgg
1381 ggttgccaga tttgactaag ccctttgaac tctttgtcga cgagaagcag ggctacgcca
1441 aaggtgtcct aacgcaaaaa ctgggaccct ggcgtcggcc ggtggcctac ctgtccaaaa
1501 agctagaccc agtagcagct gggtggcccc cttgcctacg gatggtagca gccattgccg
1561 tactgacaaa ggatgcaggc aagctaacca tgggacagcc actagtcatt ctggcccccc
1621 atgcagtaga ggcactagtc aaacaacccc ccgaccgctg gctttccaac gcccggatga
1681 ctcactatca ggccttgctt ttggacacgg accgggtcca gttcggaccg gtggtagccc
1741 tgaaccggc tacgctgctc ccactgcctg aggaagggct gcaacacaac tgccttgata
1801 tcctggccga agcccacgga acccgacccg acctaacgga ccagccgctc ccagacgccg
1861 accacacctg gtacacggat ggaagcagtc tcttacaaga gggacagcgt aaggcgggag
1921 ctgcggtgac caccgagacc gaggtaatct gggctaaagc cctgccagcc gggacatccg
1981 ctcagcgggc tgaactgata gcactcaccc aggccctaaa gatggcagaa ggtaagaagc
2041 taaatgttta tactgatagc cgttatgctt ttgctactgc ccatatccat ggagaaatat
2101 acagaaggcg tgggttgctc acatcagaag gcaaagagat caaaaataaa gacgagatct
2161 tggccctact aaaagcccctc tttctgccca aaagacttag cataatccat tgtccaggac
2221 atcaaaaggg acacagcgcc gaggctagag gcaaccggat ggctgaccaa gcggcccgaa
2281 aggcagccat cacagagact ccagacacct taccctcct catagaaaat tcatcaccca
2341 attcccgctt aattaattaa gcttgcggcc gcactcgagc accaccacca ccaccactga
2401 gatccggctg ctaacaaagc ccgaaaggaa gctgagttgg ctgctgccac cgctgagcaa
2461 taactagcat aacccttggg ggcctctaaa cgggtcttga gggtttttt gctgaaagga
2521 ggaactatat ccggattggc gaatgggacg cgccctgtag cggcgcatta gcgcggcgg
2581 gtgtggtggt tacgcgcagc gtgaccgcta cacttgccag cgccctagcg cccgctcctt
2641 tcgctttctt cccttccttt ctcgccacgt tcgccggctt tccccgtcaa gctctaaatc
2701 gggggctccc tttagggttc cgatttagtg cttacggca cctcgacccc aaaaaacttg
2761 attagggtga tggttcacgt agtgggccat cgccctgata gacggttttt cgccctttga
2821 cgttggagtc cacgttcttt aatagtggac tcttgttcca aactggaaca acactcaacc
2881 ctatctcggt ctattctttt gatttataag ggatttttgcc gatttcggcc tattggttaa
2941 aaaatgagct gatttaacaa aaatttaacg cgaattttaa caaaatatta cgtttacaa
3001 tttcaggtgg cacttttcgg ggaaatgtgc gcggaacccc tatttgttta ttttctaaa
3061 tacattcaaa tatgtatccg ctcatgagac aataaccctg ataaatgctt caataatatt
3121 gaaaaaggaa gagtatgagt attcaacatt tccgtgtcgc ccttattccc ttttttgcgg
3181 cattttgcct tcctgttttt gctcacccag aaacgctggt gaaagtaaaa gatgctgaag
3241 atcagttggg tgcacgagtg ggttacatcg aactggatct caacagcggt aagatccttg
3301 agagttttcg ccccgaagaa cgttttccaa tgatgagcac ttttaaagtt ctgctatgtg
3361 gcgcggtatt atcccgtatt gacgccgggc aagagcaact cggtcgccgc atacactatt
3421 ctcagaatga cttggttgag tactcaccag tcacagaaaa gcatcttacg gatggcatga
3481 cagtaagaga attatgcagt gctgccataa ccatgagtga taacactgcg gccaacttac
```

```
3541 ttctgacaac gatcggagga ccgaaggagc taaccgcttt tttgcacaac atggggatc
3601 atgtaactcg ccttgatcgt tgggaaccgg agctgaatga agccatacca aacgacgagc
3661 gtgacaccac gatgcctgca gcaatggcaa caacgttgcg caaactatta actggcgaac
3721 tacttactct agcttcccgg caacaattaa tagactggat ggaggcggat aaagttgcag
3781 gaccacttct gcgctcggcc cttccggctg gctggtttat tgctgataaa tctggagccg
3841 gtgagcgtgg gtctcgcggt atcattgcag cactggggcc agatggtaag ccctcccgta
3901 tcgtagttat ctacacgacg gggagtcagg caactatgga tgaacgaaat agacagatcg
3961 ctgagatagg tgcctcactg attaagcatt ggtaactgtc agaccaagtt tactcatata
4021 tactttagat tgatttaaaa cttcattttt aatttaaaag gatctaggtg aagatccttt
4081 ttgataatct catgaccaaa atcccttaac gtgagttttc gttccactga gcgtcagacc
4141 ccgtagaaaa gatcaaagga tcttcttgag atccttttt tctgcgcgta atctgctgct
4201 tgcaaacaaa aaaaccaccg ctaccagcgg tggtttgttt gccggatcaa gagctaccaa
4261 ctcttttttcc gaaggtaact ggcttcagca gagcgcagat accaaatact gtccttctag
4321 tgtagccgta gttaggccac cacttcaaga actctgtagc accgcctaca tacctcgctc
4381 tgctaatcct gttaccagtg gctgctgcca gtggcgataa gtcgtgtctt accgggttgg
4441 actcaagacg atagttaccg gataaggcgc agcggtcggg ctgaacgggg ggttcgtgca
4501 cacagcccag cttggagcga acgacctaca ccgaactgag atacctacag cgtgagctat
4561 gagaaagcgc cacgcttccc gaagggagaa aggcggacag gtatccggta agcggcaggg
4621 tcggaacagg agagcgcacg agggagcttc caggggggaaa cgcctggtat ctttatagtc
4681 ctgtcgggtt tcgccacctc tgactgagc gtcgattttt gtgatgctcg tcagggggc
4741 ggagcctatg gaaaaacgcc agcaacgcgg ccttttacg gttcctggcc ttttgctggc
4801 cttttgctca catgttcttt cctgcgttat cccctgattc tgtggataac cgtattaccg
4861 cctttgagtg agctgatacc gctcgccgca gccgaacgac cgagcgcagc gagtcagtga
4921 gcgaggaagc ggaagagcgc ctgatgcggt attttctcct tacgcatctg tcggtattt
4981 cacaccgcat atatggtgca ctctcagtac aatctgctct gatgccgcat agttaagcca
5041 gtatacactc cgctatcgct acgtgactgg gtcatggctg cgccccgaca cccgccaaca
5101 cccgctgacg cgccctgacg ggcttgtctg ctcccggcat ccgcttacag acaagctgtg
5161 accgtctccg ggagctgcat gtgtcagagg ttttcaccgt catcaccgaa acgcgcgagg
5221 cagctgcggt aaagctcatc agcgtggtcg tgaagcgatt cacagatgtc tgcctgttca
5281 tccgcgtcca gctcgttgag tttctccaga agcgttaatg tctggcttct gataaagcgg
5341 gccatgttaa gggcggtttt ttcctgtttg gtcactgatg cctccgtgta aggggggattt
5401 ctgttcatgg gggtaatgat accgatgaaa cgagagagga tgctcacgat acggggttact
5461 gatgatgaac atgcccggtt actggaacgt tgtgagggta aacaactggc ggtatggatg
5521 cggcgggacc agagaaaaat cactcagggt caatgccagc gcttcgttaa tacagatgta
5581 ggtgttccac agggtagcca gcagcatcct gcgatgcaga tccggaacat aatggtgcag
5641 ggcgctgact tccgcgtttc cagactttac gaaacacgga aaccgaagac cattcatgtt
5701 gttgctcagg tcgcagacgt tttgcagcag cagtcgcttc acgttcgctc gcgtatcggt
5761 gattcattct gctaaccagt aaggcaaccc cgccagccta gccgggtcct caacgacagg
5821 agcacgatca tgcgcacccg tggggccgcc atgccggcga taatggcctg cttctcgccg
5881 aaacgtttgg tggcgggacc agtgacgaag gcttgagcga gggcgtgcaa gattccgaat
5941 accgcaagcg acaggccgat catcgtcgcg ctccagcgaa agcggtcctc gccgaaaatg
6001 acccagagcg ctgccggcac ctgtcctacg agttgcatga taaagaagac agtcataagt
6061 gcggcgacga tagtcatgcc ccgcgcccac cggaaggagc tgactgggtt gaaggctctc
6121 aagggcatcg gtcgagatcc cggtgcctaa tgagtgagct aacttacatt aattgcgttg
6181 cgctcactgc ccgctttcca gtcgggaaac ctgtcgtgcc agctgcatta atgaatcggc
6241 caacgcgcgg ggagaggcgg tttgcgtatt gggcgccagg gtggtttttc tttcaccag
6301 tgagacgggc aacagctgat tgcccttcac cgcctggccc tgagagagtt gcagcaagcg
6361 gtccacgctg gtttgcccca gcaggcgaaa atcctgtttg atggtggtta acggcgggat
6421 ataacatgag ctgtcttcgg tatcgtcgta tcccactacc gagatatccg caccaacgcg
6481 cagcccggac tcggtaatgg cgcgcattgc gcccagcgcc atctgatcgt tggcaaccag
6541 catcgcagtg ggaacgatgc cctcattcag catttgcatg gtttgttgaa aaccggacat
6601 ggcactccag tcgccttccc gttccgctat cggctgaatt tgattgcgag tgagatattt
6661 atgccagcca gccagacgca gacgcgccga gacagaactt aatgggcccg ctaacagcgc
6721 gatttgctgg tgacccaatg cgaccagatg ctccacgccc agtcgcgtac cgtcttcatg
```

```
6781 ggagaaaata atactgttga tgggtgtctg gtcagagaca tcaagaaata acgccggaac
6841 attagtgcag gcagcttcca cagcaatggc atcctggtca tccagcggat agttaatgat
6901 cagcccactg acgcgttgcg cgagaagatt gtgcaccgcc gctttacagg cttcgacgcc
6961 gcttcgttct accatcgaca ccaccacgct ggcacccagt tgatcggcgc gagatttaat
7021 cgccgcgaca atttgcgacg gcgcgtgcag ggccagactg gaggtggcaa cgccaatcag
7081 caacgactgt ttgcccgcca gttgttgtgc cacgcggttg ggaatgtaat tcagctccgc
7141 catcgccgct tccactttt cccgcgtttt cgcagaaacg tggctggcct ggttcaccac
7201 gcgggaaacg gtctgataag agacaccggc atactctgcg acatcgtata acgttactgg
7261 tttcacattc accaccctga attgactctc ttccgggcgc tatcatgcca taccgcgaaa
7321 ggttttgcgc cattcgatgg tgtccgggat ctcgacgctc tcccttatgc gactcctgca
7381 ttaggaagca gcccagtagt aggttgaggc cgttgagcac cgccgccgca aggaatggtg
7441 catgcaagga gatggcgccc aacagtcccc cggc
```

SEQ ID No: 20 oligonucleotide (19 b)
pD-ter-
5'-AAGAAGACACGATCCACCG-3'

SEQ ID No: 21 oligonucleotide (35 b)
long+
5'- CGAACGTGGCGAGAAAGGAAGGGAAGAAAGAAGTC-3'

SEQ ID No: 22 oligonucleotide (71 b + 3' modification ddC)
ddC-Long2
5'-TTTTTTTTAGACTTCTTTCTTCCCTTCCTTTCTCGCCACGTTCGAAGAAGACACGATCCACCGCCGGT TCCG-ddC-3'

SEQ ID No: 23 oligonucleotide (35 b + 3' Biotin (TEG)
Long+Tb
5'- CGAACGTGGCGAGAAAGGAAGGGAAGAAAGAAGTC-Bio-3'

REFERENCES

Mattheakis L C, Bhatt R R, Dower W J. An in vitro polysome display system for identifying ligands from very large peptide libraries. Proc Natl Acad Sci USA. 1994 Sep. 13; 91(19):9022-6.

Matsuura T, Pluckthun A. Selection based on the folding properties of proteins with ribosome display. FEBS Lett. 2003 Mar. 27; 539(1-3):24-8.

Hanes J, Pluckthun A. In vitro selection and evolution of functional proteins by using ribosome display. Proc Natl Acad Sci USA. 1997 May 13; 94(10):4937-42.

He M, Taussig M J. Antibody-ribosome-mRNA (ARM) complexes as efficient selection particles for in vitro display and evolution of antibody combining sites. Nucleic Acids Res. 1997 Dec. 15; 25(24):5132-4.

Irving R A, Coia G, Roberts A, Nuttall S D, Hudson P J. Ribosome display and affinity maturation: from antibodies to single V-domains and steps towards cancer therapeutics. J Immunol Methods. 2001 Feb. 1; 248(1-2):31-45. Review.

Amstutz P, Pelletier J N, Guggisberg A, Jermutus L, Cesaro-Tadic S, Zahnd C, Pluckthun A. In vitro selection for catalytic activity with ribosome display. J Am Chem Soc. 2002 Aug. 14; 124(32):9396-403.

Takahashi F, Ebihara T, Mie M, Yanagida Y, Endo Y, Kobatake E, Aizawa M. Ribosome display for selection of active dihydrofolate reductase mutants using immobilized methotrexate on agarose beads. FEBS Lett. 2002 Mar. 6; 514(1):106-10.

Tawfik D S, Griffiths A D. Man-made cell-like compartments for molecular evolution. Nat Biotechnol. 1998 July; 16(7):652-6.

Lee Y F, Tawfik D S, Griffiths A D. Investigating the target recognition of DNA cytosine-5 methyltransferase HhaI by library selection using in vitro compartmentalisation. Nucleic Acids Res. 2002 Nov. 15; 30(22):4937-44.

Cohen H M, Tawfik D S, Griffiths A D. Altering the sequence specificity of HaeIII methyltransferase by directed evolution using in vitro compartmentalization. Protein Eng Des Sel. 2004 January; 17(1):3-11.

Ghadessy F J, Ong J L, Holliger P. Directed evolution of polymerase function by compartmentalized self-replication. Proc Natl Acad Sci USA. 2001 Apr. 10; 98(8):4552-7. Epub 2001 Mar. 27.

Ghadessy F J, Ramsay N, Boudsocq F, Loakes D, Brown A, Iwai S, Vaisman A, Woodgate R, Holliger P. Generic expansion of the substrate spectrum of a DNA polymerase by directed evolution. Nat Biotechnol. 2004 June; 22(6):755-9. Epub 2004 May 23.

Ong J L, Loakes D, Jaroslawski S, Too K, Holliger P. Directed evolution of DNA polymerase, RNA polymerase and reverse transcriptase activity in a single polypeptide. J Mol Biol. 2006 Aug. 18; 361(3):537-50. Epub 2006 Jul. 5.

Bernath K, Hai M, Mastrobattista E, Griffiths A D, Magdassi S, Tawfik D S. In vitro compartmentalization by double emulsions: sorting and gene enrichment by fluorescence activated cell sorting. Anal Biochem. 2004 Feb. 1; 325(1):151-7.

Mastrobattista E, Taly V, Chanudet E, Treacy P, Kelly B T, Griffiths A D. High-throughput screening of enzyme libraries: in vitro evolution of a beta-galactosidase by fluorescence-activated sorting of double emulsions. Chem Biol. 2005 December; 12(12):1291-300.

Bertschinger J, Neri D. Covalent DNA display as a novel tool for directed evolution of proteins in vitro. Protein Eng Des Sel. 2004 September; 17(9):699-707. Epub 2004 Nov. 2.

Doi N, Yanagawa H. STABLE: protein-DNA fusion system for screening of combinatorial protein libraries in vitro. FEBS Lett. 1999 Aug. 27; 457(2):227-30.

Yonezawa M, Doi N, Kawahashi Y, Higashinakagawa T, Yanagawa H. DNA display for in vitro selection of diverse peptide libraries. Nucleic Acids Res. 2003 Oct. 1; 31(19): e118.

Sepp A, Choo Y. Cell-free selection of zinc finger DNA-binding proteins using in vitro compartmentalization. J Mol Biol. 2005 Nov. 25; 354(2):212-9. Epub 2005 Oct. 3.

Sepp A, Tawfik D S, Griffiths A D. Microbead display by in vitro compartmentalisation: selection for binding using flow cytometry. FEBS Lett. 2002 Dec. 18; 532(3):455-8.

Griffiths A D, Tawfik D S. Directed evolution of an extremely fast phosphotriesterase by in vitro compartmentalization. EMBO J. 2003 Jan. 2; 22(1):24-35.

Bernath K, Magdassi S, Tawfik D S. Directed evolution of protein inhibitors of DNA-nucleases by in vitro compartmentalization (IVC) and nano-droplet delivery. J Mol Biol. 2005 Feb. 4; 345(5):1015-26. Epub 2004 Dec. 7.

Thorsen T, Roberts R W, Arnold F H, Quake S R. Dynamic pattern formation in a vesicle-generating microfluidic device. Phys Rev Lett. 2001 Apr. 30; 86(18):4163-6.

Okushima S, Nisisako T, Torii T, Higuchi T. Controlled production of monodisperse double emulsions by two-step droplet breakup in microfluidic devices. Langmuir. 2004 Nov. 9; 20(23):9905-8.

Song H, Tice J D, Ismagilov R F. A microfluidic system for controlling reaction networks in time. Angew Chem Int Ed Engl. 2003 Feb. 17; 42(7):768-72.

Link D R, Grasland-Mongrain E, Dud A, Sarrazin F, Cheng Z, Cristobal G, Marquez M, Weitz D A. Electric control of droplets in microfluidic devices. Angew Chem Int Ed Engl. 2006 Apr. 10; 45(16):2556-60.

Matsuura T, Yanagida H, Ushioda J, Urabe I, Yomo T. Nascent chain, mRNA, and ribosome complexes generated by a pure translation system. Biochem Biophys Res Commun. 2007 Jan. 12; 352(2):372-7. Epub 2006 Nov. 17.

Gerard G F, D'Alessio J M, Kotewicz M L, Noon M C. Influence on stability in Escherichia coli of the carboxy-terminal structure of cloned Moloney murine leukemia virus reverse transcriptase. DNA. 1986 August; 5(4):271-9.

Forrer P, Jaussi R. High-level expression of soluble heterologous proteins in the cytoplasm of Escherichia coli by fusion to the bacteriophage lambda head protein D. Gene. 1998 Dec. 11; 224(1-2):45-52.

Gerard G F, Potter R J, Smith M D, Rosenthal K, Dhariwal G, Lee J, Chatterjee D K. The role of template-primer in protection of reverse transcriptase from thermal inactivation. Nucleic Acids Res. 2002 Jul. 15; 30(14):3118-29.

Vichier-Guerre S, Ferris S, Auberger N, Mahiddine K, Jestin J L. A population of thermostable reverse transcriptases evolved from Thermus aquaticus DNA polymerase I by phage display. Angew Chem Int Ed Engl. 2006 Sep. 18; 45(37):6133-7.

Ghadessy F J, Holliger P. A novel emulsion mixture for in vitro compartmentalization of transcription and translation in the rabbit reticulocyte system. Protein Eng Des Sel. 2004 March; 17(3):201-4. Epub 2004 Feb. 27.

Roberts R W, Szostak J W. RNA-peptide fusions for the in vitro selection of peptides and proteins. Proc Natl Acad Sci USA. 1997 Nov. 11; 94(23):12297-302.

Odegrip R, Coomber D, Eldridge B, Hederer R, Kuhlman P A, Ullman C, FitzGerald K, McGregor D. CIS display: In vitro selection of peptides from libraries of protein-DNA complexes. Proc Natl Acad Sci USA. 2004 Mar. 2; 101(9): 2806-10. Epub 2004 Feb. 23.

Reiersen H, Løbersli I, Løset G A, Hvattum E, Simonsen B, Stacy J E, McGregor D, Fitzgerald K, Welschof M, Brekke O H, Marvik O J. Covalent antibody display—an in vitro antibody-DNA library selection system. Nucleic Acids Res. 2005 Jan. 14; 33(1):e10.

Bertschinger J, Neri D. Covalent DNA display as a novel tool for directed evolution of proteins in vitro. Protein Eng Des Sel. 2004 September; 17(9):699-707. Epub 2004 Nov. 2.

Stein V, Sielaff I, Johnsson K, Hollfelder F. A covalent chemical genotype-phenotype linkage for in vitro protein evolution. Chembiochem. 2007 Dec. 17; 8(18):2191-4.

Tabuchi I, Soramoto S, Nemoto N, Husimi Y. An in vitro DNA virus for in vitro protein evolution. FEBS Lett. 2001 Nov. 23; 508(3):309-12.

Applicants incorporate by reference the material contained in the accompanying computer readable Sequence Listing identified as SEQ_TXT.txt, having a file creation date of Feb. 29, 2012 2:09 P.M. and file size of 651 kilobytes.

SEQUENCE LISTING (128 sequences)

SEQ ID NO: 1 - DNA, 7873 bp, Artificial Sequence
  plasmid pET-his-MLV-pD
cacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctatacgaaattaatacgactcactatagggagaccacaacggtttccctctagaaataattttgtttaactttaagaaagaggagaaattacatatgagaggatcgcatcaccatcaccatcacggatctggttccatgggcatgaccctaaatatagaagatgagcatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttgatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtaccctctcaccaaaacggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggttgctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcacccaattcccgcttaattaatgaattcggatccggtggcggttccggcggtggatctatgggtaccgcaaccgcgcccggcggattgagtgcgaaagcgcctgcaatgaccccgctgatgctggacacctccagccgtaagctggttgcgtgggatggcaccaccgacggtgctgccgttggcattcttgcggttgctgctgaccagaccagcaccacgctgacgttctacaagtccggcacgttccgttatgaggatgtgctctggccggaggctgccagcgacgagacgaaaaaacggaccgcgtttgccggaacggcaatcagcatcgttggatctggtggcggttccggcggtggatctggtggcggttccggcggtggatctggtggcggttccggcggtggatcgtgtcttctttaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggc

SEQ ID NO: 2 - DNA, 7702 bp, Artificial Sequence
  plasmid pET_his_del_pD
cacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctatacgaaattaatacgactcactatagggagaccacaacggtttccctctagaaataattttgtttaactttaagaaagaggagaaattacatatgagaggatcgcatcaccatcaccatcacggatctggttccatgggcatgaccctaaatatagaagatgagcatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttgatgaggcactgcacagagacctagcagacttccggatccagcacccagacttgatcctgctacagtacgtggatgacttactgctggccgccacttctgagctagactgccaacaaggtactcgggccctgttacaaaccctagggacggcaggcttctgtcgcctctggatccctgggtttgcagaaatggcagcccccttgtaccctctcaccaaaacggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactaatagccgttatgcttttgctactgcccatatccatggagaaatatacagaaggcgtgggttgctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcacccaattcccgcttaattaatgaattcggatccggtggcggttccggcggtggatctatgggtaccgcaaccgcgcccggcggattgagtgcgaaagcgcctgcaatgaccccgctgatgctggacacctccagccgtaagctggttgcgtgggatggcaccaccgacggtgctgccgttggcattcttgcggttgctgctgaccagaccagcaccacgctgacgttctacaagtccggcacgttccgttatgaggatgtgctctggccggaggctgccagcgacgagacgaaaaaacggaccgcgtttgccggaacggcaatcagcatcgttggatctggtggcggttccggcggtggatctggtggcggttccggcggtggatctggtggcggttccggcggtggatcgtgtcttctttaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggc

SEQ ID NO: 3 - DNA, 22 bp, Artificial Sequence
  oligonucleotide pro-pIVEX
gcgagcccgatcttccccatcg

SEQ ID NO: 4 - DNA, 21 bp, Artificial Sequence
  oligonucleotide pD-ter
aagaagacacgatccaccgcc

SEQ ID NO: 5 - DNA, 38 bp, Artificial Sequence
  oligonucleotide assrA
ttaagctgctaaagcgtagttttcgtcgtttgcgacta

SEQ ID NO: 6 - protein, 833 aa, Artificial Sequence
  MLV_pD
MRGSHHHHHHGSGSMGMTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLINEFGSGGGSGGGSMGTATAPGGLSAKAPAMTPLMLDTSSRKLVAWDGTTDGAAVGILAVAADQTSTTLTFYKSGTFRYEDVLWPEAASDETKKRTAFAGTAISIVGSGGGSGGGSGGGSGGGSGGGSGGGSCLL

SEQ ID NO: 7 - protein, 776 aa, Artificial Sequence
  del_pD
MRGSHHHHHHGSGSMGMTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLINEFGSGGGSGGGSMGTATAPGGLSAKAPAMTPLMLDTSSRKLVAWDGTTDGAAVGILAVAADQTSTTLTFYKSGTFRYEDVLWPEAASDETKKRTAFAGTAISIVGSGGGSGGGSGGGSGGGSGGGSGGGSCLL

SEQ ID NO: 8 - DNA, 15 bp, Artificial Sequence
  oligonucleotide pD_42
ttacggctggaggtg

SEQ ID NO: 9 - DNA, 28 bp, Artificial Sequence
  oligonucleotide RD_Nde
ctttaagaaagaggagaaattacatatg

SEQ ID NO: 10 - DNA, 14 bp, Artificial Sequence
  oligonucleotide pD_55
gccgggcgcggttg

SEQ ID NO: 11 - DNA, 23 bp, Artificial Sequence
  oligonucleotide M_F
gatcaagccccacatacagagac

SEQ ID NO: 12 - DNA, 19 bp, Artificial Sequence
  oligonucleotide M_2R
gccctgcttctcgtcgaca

SEQ ID NO: 13 - DNA, 40 bp, Artificial Sequence
  oligonucleotide M_Esp
atcgtctcccatgggcatgaccctaaatatagaagatgag

SEQ ID NO: 14 - DNA, 32 bp, Artificial Sequence
  oligonucleotide M_Eri
aatgaattcattaattaagcgggaattgggtg

SEQ ID NO: 15 - DNA, 18 bp, Artificial Sequence
  oligonucleotide M_1R
cagggcccgagtaccttg

SEQ ID NO: 16 - DNA, 17 bp, Artificial Sequence
  oligonucleotide M_3F
ccagttcggaccggtgg

SEQ ID NO: 17 - DNA, 19 bp, Artificial Sequence
  oligonucleotide pD_ter-
aagaagacacgatccaccg

SEQ ID NO: 18 - DNA, 36 bp, Artificial Sequence
  oligonucleotide M_Hind3+
cggatcaagcttaattaattaagcgggaattgggtg

SEQ ID NO: 19 - DNA, 7474 bp, Artificial Sequence
  plasmid pET_his_MLV
cacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctatacgaaattaatacgactcactatagggagaccacaacggtttccctctagaaataattttgtttaactttaagaaagaggagaaattacatatgagaggatcgcatcaccatcaccatcacggatctggttccatgggcatgaccctaaatatagaagatgagcatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttgatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtaccctctcaccaaaacggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggttgctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcacccaattcccgcttaattaattaagcttgcggccgcactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggattggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggc

SEQ ID NO: 20 - DNA, 19 bp, Artificial Sequence
  oligonucleotide pD-ter-
aagaagacacgatccaccg

SEQ ID NO: 21 - DNA, 35 bp, Artificial Sequence
  oligonucleotide long +
cgaacgtggcgagaaaggaagggaagaaagaagtc

SEQ ID NO: 22 - DNA, 72 bp, Artificial Sequence
  oligonucleotide ddC-Long2 (71b + 3' modification ddC)
  modified_base (72)..(72): modification ddC
tttttttagacttctttcttcccttcctttctcgccacgttcgaagaagacacgatccaccgccggttccgc

SEQ ID NO: 23 - DNA, 35 bp, Artificial Sequence; identical to SEQ ID NO: 21
  oligonucleotide Long+Tb (35b + 3' Biotin (TEG))

SEQ ID NO: 24 - DNA, 2066 bp, Murine Leukemia Virus
ccatgggcatgaccctaaatatagaagatgagcatcggctacatgagacctcaaaagagccagatgtttctctagggtccacatggctgtctgattttcctcaggcctgggcggaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccctggaacacgcccctgctacccgttaagaaaccagggactaatgattataggcctgtccaggatctgagagaagtcaacaagcgggtggaagacatccaccccaccgtgcccaacccttacaacctcttgagcgggctcccaccgtcccaccagtggtacactgtgcttgatttaaaggatgcctttttctgcctgagactccaccccaccagtcagcctctcttcgcctttgagtggagagatccagagatgggaatctcaggacaattgacctggaccagactcccacagggtttcaaaaacagtcccaccctgtttgatgaggcactgcacagagacctagcagacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcaagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtaccctctcaccaaaacggggactctgtttaattggggcccagaccaacaaaaggcctatcaagaaatcaagcaagctcttctaactgccccagccctggggttgccagatttgactaagccctttgaactctttgtcgacgagaagcagggctacgccaaaggtgtcctaacgcaaaaactgggaccttggcgtcggccggtggcctacctgtccaaaaagctagacccagtagcagctgggtggcccccttgcctacggatggtagcagccattgccgtactgacaaaggatgcaggcaagctaaccatgggacagccactagtcattctggccccccatgcagtagaggcactagtcaaacaaccccccgaccgctggctttccaacgcccggatgactcactatcaggccttgcttttggacacggaccgggtccagttcggaccggtggtagccctgaacccggctacgctgctcccactgcctgaggaagggctgcaacacaactgccttgatatcctggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatccgctcagcgggctgaactgatagcactcacccaggccctaaagatggcagaaggtaagaagctaaatgtttatactgatagccgttatgcttttgctactgcccatatccatggagaaatatacagaaggcgtgggttgctcacatcagaaggcaaagagatcaaaaataaagacgagatcttggccctactaaaagccctctttctgcccaaaagacttagcataatccattgtccaggacatcaaaagggacacagcgccgaggctagaggcaaccggatggctgaccaagcggcccgaaaggcagccatcacagagactccagacacctctaccctcctcatagaaaattcatcacccaattcccgcttaattaatgaattc

SEQ ID NO: 25 - protein, 683 aa, Murine Leukemia Virus
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 26 - protein, 683 aa, Artificial Sequence
  Mutant MLV reverse transcriptase
TLNIEDEHRLHETSKEPDVSLGSTWLSDFPQAWAETGGMGLAVRQAPLVIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTAGSSLLQEGQRKAGAAVTTETEVIWAKALPAGTSAQRAELIALTQALKMAEGKKLNVYTDSRYAFATAHIRGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 27 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLRYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTLGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRRWLTSEGKEIKNKDEILALLKALFLPKRLSIIHCPGHQKGHSAEARGNRMADQAARKAAITETPDTSTLLIENSSPNSRLIN

SEQ ID NO: 28 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEDRKETVMGQPTPKTPRQLREFLGTAGFCRLWIPGFAEMAAPLYPLTKTGTLFNWGPDQQKAYQEIKQALLTAPALVLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMANQAARKAAITETPDTSTLLIENSSPNSRLIN

SEQ ID NO: 29 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALRRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLAILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKIAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 30 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVSCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKEAVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPFPDADHTWYTDGSSLLQEGQRKAGAAVTTETEVIWAKALPAGTSAQRAELIALTQALKMAEGKKLNVYTDSRYAFATAHIHGEIYRRRGLLTSKGKEIKNKDEILALLKALFLPKRLSIIHSPGHQKGHSAEARGNRMADQAARKAAITDTPDTSTLLIENSSPNSRLIN

SEQ ID NO: 31 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPTTLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 32 - protein, 683 aa, Artificial Sequence
  Mutant MLV reverse transcriptase
TLNIEDEHRLHETSKEPDVSLGSTWLSDLPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTMLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRWPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAAQAARKAAITETPDTSTLLIENSSPNSRLIN

SEQ ID NO: 33 - protein, 683 aa, Artificial Sequence
  Mutant MLV reverse transcriptase
TLNIEDEHRLHETSKEPDVSLGPTWLSDFPQAWAETGGMGLAVRQAPLIIPLKATSTPVSIKQYPMSQEARLGIKPHIQRLLDQGILAPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCRQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKVLFLPKRLSIIHCPGHQKGHSAEARGNRMADQAARKAAITETPDTSTLLIENSSPNSRLIN

SEQ ID NO: 34 - protein, 683 aa, Artificial Sequence
  Mutant MLV reverse transcriptase
TLNIEDEHRLHETSKEPDVSLGSTWLSDFPQAWAETGGMGLAVRQAPLIISLKATSTPVSIKQYPMSQEARLGIKPHIQRLLDQGILVPCQSPWNTPLLPVKKPGTNDYRPVQDLREVNKRVEDIHPTVPNPYNLWSGLPPSHQWYTVLDLKDAFFCLRLHPTSQPLFAFEWRDPEMGISGQLTWTRLPQGFKNSPTLFDEALHRDPADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTLGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQWAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLIN

SEQ ID NO: 35 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTQALLQTLGNLGYRASAKKTQICQKQVKYLGYLLKEGQRWLTEARKETVMGQPTPKTPRQLREFLGTAGFCHLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTEIEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQATRKAAITETPDTSTLLIENSSPNSRLIN

SEQ ID NO: 36 - protein, 683 aa, Artificial Sequence
  Mutant MLV reverse transcriptase
TLNIEDEHRLHETSKEPDVSLGSTWLSDFPQAWAETGGMGLAVRQAPLVIPLKATSTPVSIKQYSMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPRLRMVAAIAVLTKDAGKLTMGQPLVILAPHAVEALVKQPPDRWLSNARMTHYQALLLDTDRAQFGPVVALNPATLLPLPEEGLQHNCLDILAEVHGTRPDLTDQPLPDADHTWYTDGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 37 - protein, 680 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLNQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALDPATLLPLPEEGLQHNCLDILAEAHGTRPDLTDQPLPDADHTWYTDGSSLLQEGQRKAGAAVTTETEVIWAKALPAGTSAQRAELIALTQALKMAEGKQLNVYTGSRYAFATAHIHGEIYRRRGLLTSEGKEIKNKDEIVALLKALFLPKRLSIIHCPGHQKGHSAEARGNRMADQAARKAAITETPDTSTLLIENSSPIPA

SEQ ID NO: 38 - protein, 680 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPIPA

SEQ ID NO: 39 - protein, 680 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPSPYNLLSGLPPSHQWYTVLDLKDAFFCLRLHPTSQPLFAFEWRDPEMGTSGQLTWTRLPQGFKNSPTLFDEALRRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAALLYPLTKTGTLFNWGPDQQKAYQEIKQALLAAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTASRYAFATAHIHGEIYRRRGLLTSEGKEIKNKDEILALLKALFLPKRLSIIHCPGHQKGHSAEARGNRMADQAARKAAITETPDTSTLLIENSSPIPA

SEQ ID NO: 40 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLRYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGILFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTAGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSVEARGNRMADQAARKAAVTETPDTSTLLIENSSPNSRLIN

SEQ ID NO: 41 - protein, 683 aa, Artificial Sequence
  Mutant MLV reverse transcriptase
TLNIEDERRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSTIHCPGHQKGHSVEARGNRMADQAARKAAITETPDTSTLLIENSSPNSRLIN

SEQ ID NO: 42 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGMAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTNGSSLLQEGQRKAGAAVTTETEVIWAKALPAGTSAQRAELIALTQALKMAEGKKLNVYTGSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 43 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPRLRMVAAIAVLTKDAGKLTMGQPLVILAPHAVEALVKQPPDRWLSNARMTHYQALLLDTDRAQFGPVVALNPATLLPLPEEGLQHNCLDILAEVHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 44 - protein, 683 aa, Artificial Sequence
  Mutant MLV reverse transcriptase
TLNIKDEHRLHETSKEPDVSLGSTWLSDFPQAWAETGGMGLAIRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLAWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRLVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTKTEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 45 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDVHPTVPNPYNLLSRLPPSRQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGALTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKAPPAGTSAQRAELIALTQALKMAEGKKLNVYTDSRYAFATAHIHGEIYRRRGWLTSEGKEIKNKDEILALLRALFLPKRLSIIHCPGHQKGHSAEARGNRMADQAARQAAITETPDTPTLLIENSSPNSRLIN

SEQ ID NO: 46 - protein, 680 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLVDFRIQHPDLILLQYVDGLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSA

SEQ ID NO: 47 - protein, 680 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKEAVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTAGSSLLQEGQRKAGAAVTTETEVIWAKALPAGTSAQRAELIALTQALKMAEGKKLNVYTDSRYAFATAHIRGEIYRRRGLLTSEGKEIKNKDEILALLKALFLPKRLSIIHCPGHQKGHSAEARGNRMADQAARKAAITETPDTSTLLIENSSPNSP

SEQ ID NO: 48 - protein, 680 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPGVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNPA

SEQ ID NO: 49 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLNQGILVPCQSPWNTPLLPVKKPGTNDYRPVQDLREVNKRVEDIHPTVPNPYNPLSGLPPSHQWYTVLDLKDAFFCLRLHPTSQSLFAFEWRDPEMGISGQLTWTRLPQGFKNSPTLFDEALHRDLADFRIQRPDLILLQCVDDLLLAATSELDCQQGTRALLQTLGNLGYRASAKKAQICQKQVKYLGYLLKEGQRWLTEARKETVMGQPAPKTPRQLREFLGTAGFCRLWIPGFAEMAAPLYPLTKTGTLFNWGPDQQKAHQEIKQALLTAPALGLPDLTKPFELFVDEKQGYAKGVLTQKLGPWRRPVAYLSKKLDPVAAGWLPCLRMVAVIAVLTKDAGKLTMGQPLVILTPHAVEALAKQLPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 50 - protein, 683 aa, Artificial Sequence
  Mutant MLV reverse transcriptase
TLNIEDEHRLHETSTEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGRKLNVYTDSRYAFATAHIHGEIYRRRGLLTSAGKEIKNKDEILALLKALFLPKRLSIIHCPGHQKGHSAEARGNRMADQAARKAAITETPDTSTLLIENSSPNSRLIN

SEQ ID NO: 51 - protein, 683 aa, Artificial Sequence
  Mutant MLV reverse transriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVSNPYNLLSGLPPSHQWYTVLDLKDAFFCLKLHPTSQPLFAFEWRDPEMGISGQLTWTRLPQGFKNSPTLFAEALHRDLADFRIQHPDLILLRYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPGRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTESRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 52 - protein, 683 aa, Artificial Sequence
  Mutant MLV reverse transcriptase
TLNIEDEHRLHETSKEPDVSLGSTWLSDFPQAWAETWGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPALFGEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLAILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLIN

SEQ ID NO: 53 - protein, 683 aa, Artificial Sequence
  Mutant MLV reverse transcriptase
TLNIEDEHRLHETSKESDVSLGSTWLSDFPQAWAETGGMGLAVRQAPLIIPLKATSTPVSIKQYPMSQEARLGIKPHIQRLLDQGILVPCQSPWNTPLLPVKKPGTNEYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTVGFCRLWIPGFAEMAAPLYPLTKTGTLFNWGPDQQKAHQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAGQAARKAAITETPDTSTLLIENSSPNSRLIN

SEQ ID NO: 54 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCLSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTGSRYAFATAHIHGEIYRKRGMLTSEGKEIKNKDEILALLKALFLPKRLSIIHCPGHQKGHSAEARGNRMADQAARKAAITETPDTSTLLIENSSPNSRLIN

SEQ ID NO: 55 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARTTHYQTLLLDTDRVQFGPVVALNPATLLPLPEEGLQHNCLDILAEAHRTRPDLTDQPLPDADHTWYTDGSSLLQEGQRKAGAAVTTETEVIWAKALPAGTSARRAELIALTQALKMAEGKKLNVYTDSRYAFATAHIHGEIYRRRGLLTSEGKEIKNKDEILALLKALFLPKRLSIIHCPGHQKGHSAEARGNRMADQVARKAAITETPDTSTLLIENSSPNSRLIN

SEQ ID NO: 56 - protein, 683 aa, Artificial Sequence
  Mutant MLV reverse transcriptase
TLNIEDEHRLHATSKEPDVSLGSTWLSDFPQAWAETGGMGLAVRQAPLIIPLKATSTPVSIKQYPMSQEARLGIKPHIQRLLDQGIPVPCQSPWSTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFAEALHRDLADFRIQHPDLILLRYVDDLLLAATSELDCQQGTRTLLQTLGNLGYRASAKKAQICQKQVKYLGYLLKEGQRWLTEARKETVMGQPTPKTPRQLREFLGTAGFCRLWIPGFAEMAAPLYPLTKTETLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTLGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLIN

SEQ ID NO: 57 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYSMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSKLDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWSPCLRMVAAIAVLTKDAGKLTMGQPLVILAPHAVEALVKQPPDRWLSNARMTHYQALLLDTDRVQFGPVVAPNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGRQKGHSAEARGNRMANQAARKAAITETPDTSTLLIENSSPNSRLIN

SEQ ID NO: 58 - protein, 683 aa, Artificial Sequence
  Mutant MLV reverse transcriptase
TLNIEDEHRLHETSKEPDVSLGSTWLSDFLQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYMDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPRRWPVAYLSKKLDPVAAGWPPCLRMVAAIAVLTKDAGKLTMGQPLVIPAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 59 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFDEALHRDLADFRIQHPDLILLRYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGSRMADQAARRAAITETPDTSTLLIENSSPNSRLIN

SEQ ID NO: 60 - protein, 683 aa, Artificial Sequence
  Mutant MLV reverse transcriptase
TLNIEDEHRLHETSKEPDVSLGSTWLSDFPQAWAETGGLGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLRKFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPERLSIIHCPGHQKGHSAEARGNRMADQAARKAAITETPDTSTLLIENSSPNSRLIN

SEQ ID NO: 61 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGAAGSCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTAGSSLLQEGQRKAGAAVTTETEVIWAKALPAGTSAQRAELIALTQALKMAEGKKLNVYTDSRYAFATAHIRGEIYRRRGLLTSEGKEIKNKDEILALLKALSLPKRLSIIHCPGHQKGHSAEARGNRMADQAARKAAITETPDTSTLLIENSSPNSRLIN

SEQ ID NO: 62 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRGPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRPWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEVHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 63 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFAEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPGRWLSNARMTHYQALLLDTDRVQFGPVVALDPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIHCPGHQKGHSAEARGNRMADQAARKAAITETPDTSTLPIENSSPNSRLIN

SEQ ID NO: 64 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQGARLGIKPHIQRLLDQGILVPCQSPWNTPLLPVKKPGTNDYRPVQDLREVNKRVEDIHPTVPNPYNPLSGPPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQQLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTGSRYAFATAHIHGEIYRRRGLLTSEGKEIKNKDEILALLKALFLPKRLSIIHCPGHQKGHSAEARGNRMADQAARKAAITETPDTSTLLIENSSPNFRLIN

SEQ ID NO: 65 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALDPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 66 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDISPTVPNPYNLLSGLPPSHQWYTVFDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSKARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 67 - protein, 683 aa, Artificial Sequence
  Mutant MLV reverse transcriptase
TLNIEDEHRLHVTSKEPDVSLGSTWLSDFPQAWAETGGMGLAVRQAPLIIPLKATSTPVSIKQYPMSQEARLGIKPHIQRLLDQGVLVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEVRGNRMADQAARKAAITETPDTSTLLIENSSPNSRLIN

SEQ ID NO: 68 - protein, 680 aa, Artificial Sequence
  Mutant MLV reverse transcriptase
TLNIEDEHRLHETSKEPDVSLGSAWLSDFPQAWAETGGMGRAVRQAPLIIPLKATSTPVSIKQYPMSQEARLGIKPHIQRLLDQGILVPCQSPWNTPLLPVKKPGTNDYRPVQDLREVNKRVEDIHSTVPNPYNLLSGLPPSHQWYTVLDFKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEARGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAGQAARKAAITETPDTSTLLIENSSPNSR

SEQ ID NO: 69 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVAIKQYPMSQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLSAFEWRDPEMGISGQLTWTRLPQGFKNSPTLYDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQDIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDHWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTGSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 70 - protein, 683 aa, Artificial Sequence
  Mutant MLV reverse transriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGLKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTPFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGASAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLIN

SEQ ID NO: 71 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCRQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALSLPKRLSIIHCPGHQKGHSAEARGNRMANQAARKAAITETPDTSTLLIENSSPNSRLIN

SEQ ID NO: 72 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQPPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGRPLVILAPHAVEALVKQPPDRWLSNARMTHYQALLLDTDRVQFGPVVALDPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 73 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIHCPGHQKGHSTEARGNRMADQAARKAAITETPDTSTLLIENSSPNSRLIN

SEQ ID NO: 74 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTSDYRPVQDLREVNKRVEDIRPAVPNPYNLLSGLPPSHQWYTVLDLKDAFFCLRLHPTSQPLFAFEWRDPEMGVSGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGYSAEARGNRMANQAARKAAITETPDTSTLLIENSSPNSRLIN

SEQ ID NO: 75 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPRIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 76 - protein, 683 aa, Artificial Sequence
  Mutant MLV reverse transcriptase
TLNIEDEHRLHETSKEPDVSLGSTWLSDFPQAWAETGGMGLAVRQAPLIVPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKSSPTLFDEALRRDLADFRIQHPDLILLQYVDDLLLAATSELDCQQGTRALLQTLGNLGYRASAKKAQICQKQVKYLGYLLKEGQRWLTEARKEAVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTAGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 77 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYGPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQQLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMANQAARKAAITETPDTSTLLIENSSPNSRLIN

SEQ ID NO: 78 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKRGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 79 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVSNPYNLLSGPPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIVVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIYCPGHQKGHSAEARGNRMADQAARKAAITETPDTSTLLIENSSPNSRLIN

SEQ ID NO: 80 - protein, 683 aa, Artificial Sequence
  Mutant MLV reverse transcriptase
TLNIKDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGARALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAHQAARKAAITETPDTSTLPIENSSPNSRLIN

SEQ ID NO: 81 - protein, 683 aa, Artificial Sequence
  Mutant MLV reverse transcriptase
TLNIEDEPRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFWIQHPDLILLQYVDDLLLAATSELDCQQGTRALLQTLGNLGYRASAKKAQICQKQVKYLGYLLKEGQRWLTEARKETVMGQLTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPPPEEGLQHNCLDILAEAHGTRPDLTDQPLPDADHTWYTAGSSLLQEGQRKAGAAVTTETEVIWAKALPAGTSAQRAELIALTQALKMAEGKKLNVYTDSRYAFATAHIRGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 82 - protein, 683 aa, Artificial Sequence
  Mutant MLV reverse transcriptase
TLNIEDEHRLHETSKEPDVSLGSTWLSDFPQAWAETGGMGLAVRQAPLVIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWKDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLRKFLGTAGFCRLWIPGFAEMAAPLYPLTKTGTLFNWGPDQQKAYQEIKQALLTAPALGLPDLTKPFELFVDEKQGYAKGVLTQKLGPWRRPAAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSSLLIENSSPNSRLIN

SEQ ID NO: 83 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPLSQEARLGIKPHIQRLLDQGILVPYQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAVQAARKAAITETPDTSTLLIENSSPNSRLIN

SEQ ID NO: 84 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDHWLSNARMTHYQALLLDTDRVQFGPVVALNPATLLPLPEEGLQHNCLDILAEARGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 85 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPAQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWPTEARKETVMGQPTPKTPRQLREFLGTAGFCRLWIPGFAEMATPLYPLTKTGTLFNWGPDQQKAYQEIKQALLTAPALGLPDLTKPFELFVDEKQGYAKSVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMANQAARKAAITETPDTSTLLIENSSPNSRLIN

SEQ ID NO: 86 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQCPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQAVLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPARWLSNARMTHYQALLLDTDRVQFGPVVALNPATLLPLPEEGLQHNCLDILAEAHGTRPDLTDQPLPDADHTWYTDGSSLLHEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 87 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREANKRVEDIHPTVPNPYNLLSGLPPSHQWYTVLDLKDAFFCLRLHPTSQPLFAFEWRDPEMGISGQLTWTRLPQGFKNSPTLFDEALRRDLADFRIQHPDLILLQYVDDLLLAATSELDCQQGTRALLQTLGNLGYRASAKKAQICQKQVKYLGYLLKEGQRWLTGARKETVMGQPTPKTPRQLREFLGTAGFCRLWIPGFAEMAAPLYPLTKTGTLFNWGPDQQKAYQDIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTAGSSILQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 88 - protein, 683 aa, Artificial Sequence; identical to SEQ ID NO: 76
  Mutant MLV reverse transcriptase

SEQ ID NO: 89 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPGLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTAGSSLLQEGQRKAGAAVTTETGVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 90 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQHGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQAIKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLIN

SEQ ID NO: 91 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSLWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARRTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLIN

SEQ ID NO: 92 - protein, 683 aa, Artificial Sequence
  Mutant MLV reverse transcriptase
TLNIEDEHRLHETSKEPDVSLGSTWLSDFPQAWAETGGVGLAVRQAPLVIPLKATSTPVSIKQYPMSQEARLGIKPHIQRLLDQGILVPCRSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALRRDLADFRIQHPDLILLQYVDDLLLAATSELDCQQGTRALLQTLGNLGYRASAKKAQICQKQVKYLGYLLKEGQRWLTEARKEAVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSKARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALLLPKRLSIIHCPGHQKGHSAEARGNRMAHQAARKAAITETPDTSTLLIENSSPNSRLIN

SEQ ID NO: 93 - protein, 683 aa, Artificial Sequence
  Mutant MLV reverse transcriptase
TLNIEDEHRLHETTKEPDVSLGSTWLSDFPQAWAETGGMGLAVRQAPLTIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGTAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMANQAARKAAITETPDTSTLLIENSSPNSRLIN

SEQ ID NO: 94 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTSLLPVKKPGTNDYRPVQDLREVNKRVEDIHPTVPNPYNLLSGLPPSHQWYTVLDLKDAFFCLRLHPTSQPLFAFEWRDPEMGISGQLAWTRLPQGFKNSPTLFDEALHRDLADFRIQHPDLILLQYVDDLLLAATSELDCQQGTRALLQTLGNPGYRASAKKAQICQKQVKYLGYLLKEGQRWLTEARKETVLGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLGILAEAHGTRPDLTDQPLPDADHTWYTDGSSLLQEGQRKAGAAVTTETEVIWAKTLPAGTSAQRAKLIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 95 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVTYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKLAEGKKLNVYTDSRYAFATAHIQGEIYRRRGLLTSEGKEIKNKDEILALLKALFLPKRLSIIHCPGHQKGHSAEARGNRMADQAARKAAITETPDTSTLPTENSSPNSRLIN

SEQ ID NO: 96 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMPQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTVGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 97 - protein, 683 aa, Artificial Sequence
  Mutant MLV reverse transcriptase
TLNIEDEHRLYETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLHPLTKTGTQFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGRPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGETYRRRGLLTSEGKEIKNKDKILALLKALFLPKRLSIIHCPGHQKGHSAEARGSRMADQAARRAAITETPDTSTLLIGNSSPNSRLIN

SEQ ID NO: 98 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPLSQEARLGIKPHIQRLLDQGILVPCQSPWNTPLLPVKKPETNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVVGQPTPKTPRQLREFLGTAGFCRLWTPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILTPHAVEALVKQPPDRWLSNARMTHYQALLLDTDRVQFGPVVALNPATLLPLPEEGPQHNCLDILAEAHGTRPDLTDQPLPDADHTWYTDGSSLLQEGQRKAGAAVTTETEVIWAKALPAGTSAQRAELIALTQALKMTEGKKLNVYTNSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 99 - protein, 683 aa, Artificial Sequence
  Mutant MLV reverse transcriptase
TLNIEDEHRLRETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTMLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTRYQALLLDTDRVQFGPVVALNPATLLPLPEEGLQHNCLDILAEVHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAGQAARKAAITETPDASTLLIENSSPNSRLIN

SEQ ID NO: 100 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGTKPHIQRLLDQGILVPCQSPWNTPLLPVKKRGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLHPLTKTGTQFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGRPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGETYRRRGLLTSEGKEIKNKDKILALLKALFLPKRLSIIHCPGHQKGHSAEARGSRMADQAARRAAITETPDTSTLLIGNSSPNSRLIN

SEQ ID NO: 101 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYSLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTGSRYAFATAHIHGEIYRRRGLLTSEGKEIKNKDEILALLKALFLPKRLSIIHCPGHQKGHSAEARGNRMADQAARKAAITETPDTSTLLIENSPPNSRLIN

SEQ ID NO: 102 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQSLFAFEWRDPEMGISGQLTWTRLPQGFKNSPTLLDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKRPPDRWLSNARMTHYQALLLDTARVQFGPVVALNPATLLPLPEEGLQHNCLDILAKAHGTRPDLTDQPLPDADHTWYTDGSSLLHEGQRKAGAAVTTETEVIWAKALPAGTSVQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 103 - protein, 683 aa, Artificial Sequence
  Mutant MLV reverse transcriptase
TLNIEDEHRLHETSKEPDVSLGSTWPSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVSNPYNLLGGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKTYQEIKQALLTAPGLGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGATVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMANQAARKAAITETPDTSTLLIENSPPNSRLIN

SEQ ID NO: 104 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIRPTVPNPYNLLSGPPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIVVLTKDAGKLTMGQPLVILAPHAVEALVKQPPDRWLSNARMTHYQALLLDTDRVQFGPVVALNPATLLPLPEEGPQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAAQAARKAAITETPDTSTLLIENSSPNSRLIN

SEQ ID NO: 105 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTASRYAFATAHIHGEIYRRRGLLTSEGKEIKNKDEILALLKALFLPKRLSIIHCPGRQKGHSAEARGNRMADQAARKAAITETPDTSTLLIENSSPNSRLIN

SEQ ID NO: 106 - protein, 683 aa, Artificial Sequence; identical to SEQ ID NO: 25
  Mutant MLV reverse transcriptase

SEQ ID NO: 107 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEVRLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALDPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALLLPKRLSIIHCPGHQKGHSAEARGNRMADQAARKAAITETPDTSTLLIENSSPNSRLIN

SEQ ID NO: 108 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPGQLREFLGTAGFCRLWIPGFAEMAAPLYPLTKPGTLFNWGPDQQKAYQEIKQALLTAPALGLPDLTKPFELFVDEKRGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 109 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDISPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAGQAARKAAITETPDTSTLLIENSSPNSRLIN

SEQ ID NO: 110 - protein, 683 aa, Artificial Sequence; identical to SEQ ID NO: 89
  Mutant MLV reverse transcriptase

SEQ ID NO: 111 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHDCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSKGKEIKNKDEILALLKALFLPKRLSIIHCPGHQKGHSAEARGNRMADQAARKAAITETPDTSTLLIENSSPNSRLIN

SEQ ID NO: 112 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEGIHPTVPNPYNLLSGLPPSHQWYTVLDLKDAFFCLRLHPTSQPLFAFEWRDPEMGISGQLTWTGLPQGFKNSPTLFDEALHRDLADFRIQHPDLILLQYVDDLLLAATSELDCQQGTRALLQTLGNLGYRASAKKAQICRKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHKCLDILAEAHGTRPDLTDQPLPDADHTWYTDGSSLLQEGQRKAGAAVTTETEVIWAKALPAGTSAQRAELIALTQALKMAEGKKLNVYTGSRYAFATAHIHGEIYRRRGLLTSEGKEIKNKDEIVALLKALFLPKRLSIIHCPGHQKGHSAEARGNRMADQAARKAAITETPDTSTLLIENSSPNSRLIN

SEQ ID NO: 113 - protein, 683 aa, Artificial Sequence; identical to SEQ ID NO: 105
  Mutant MLV reverse transcriptase

SEQ ID NO: 114 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLPPLPEEGLQHNCLDVLAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAAQAARKAAITETPDTSTLLIENSSPNSRLIN

SEQ ID NO: 115 - protein, 683 aa, Artificial Sequence
  Mutant MLV reverse transcriptase
TLNIEDEHRLHETSKEPDVSLGSTWLSDFPQAWAEIGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 116 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYSMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALRRDLADFRIQHPDLILLQYVDDLLLAATSELDCQQGTRALLQTLGNLGYRASAKKAQICQKQVKYLGYLLKEGQRWLTEDRKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRSVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 117 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNMPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAPRAELIALTQALKMAEGKKLNVYTDSRYAFATAHIHGEIYRRRGLLTSGGKEIKNKDEILALLKALFLPKRLSIIHCPGHQKGHSAEARGNRMADQAARKAAITETPDTSTLLIENSSPNSRLIN

SEQ ID NO: 118 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNSYNLLSGLPPSHQWYTVLDLKDAFFCLRLHPTGQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPRRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGKRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 119 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTNSRYAFATAHIHGEIYRRRGLLTSEGKEIKNKDEILALLKALFLPKRLSIIHRPGHQKGHSAEARGNRMADQAARKAAITETPDTSTFLIENSSPNSRLIN

SEQ ID NO: 120 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPTLFDEALHRDLADFRIQHPDLILLQYVDDLLLAATSKLDCQQGTRALLQTLGNLGYRASAKKAQICQKQVKYLGYLLKEGQRWLTEARKETVMGQPTPETPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSITHCPGHQKGRGAEARGNRMADQAARKAAITETPDTSTLLIENSSPNSRLIN

SEQ ID NO: 121 - protein, 683 aa, Artificial Sequence; identical to SEQ ID NO: 57
  Mutant MLV reverse transcriptase

SEQ ID NO: 122 - protein, 683 aa, Artificial Sequence; identical to SEQ ID NO: 71
  Mutant MLV reverse transcriptase

SEQ ID NO: 123 - protein, 683 aa, Artificial Sequence
  Mutant MLV reverse transcriptase
TLNIEDEHRLHETSKESDVSLGSTWLSDFPQAWAETGGMGLAVRQAPLIIPLKATSTPVSIKQYPMSQEARLGIKPHIQRLLDQGILVPCQSPWNTPLLPVKKPGTNEYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGDLGYRASAKKAQICQKQVKYLGYLLKEGQRWLTEARKETVMGQPTPKTPRQLREFLGTVGFCRLWIPGFAEMAAPLYPLTKTGTLFNWGPDQQKAHQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAGQAARKAAITETPDTSTLLIKNSSPNSRLIN

SEQ ID NO: 124 - protein, 683 aa, Artificial Sequence
  Mutant MLV reverse transcriptase
TLNIEDEPRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPQGFKNSPALFGEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALWLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKVLFLPKRLSIIHCPGHQKGHSAEARGNRMAAQAARKAAITETPDTSTLLIENSSPNSRLIN

SEQ ID NO: 125 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMAHQAARKAAIAETPDTSTLLIENSSPNSRLIN

SEQ ID NO: 126 - protein, 683 aa, Artificial Sequence
  Mutant MLV reverse transcriptase
TLNIEDEHRLHETPKEPDVSLGSTWLSDFPQAWAETGGMGLAVRQAPLIIPLKATSTPVSIKQYPMSQEARLGIKPHIQRLLDQGILVPCQSPWSTPLLPVKKPGTNDYRPVQDLREVNKRVEDIHPTVPNPYNLLSGPPPSHQWYTVLDLKDAFFCLRLHPTSQPLFAFEWRDPEMGISGQLTWTRLPRGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTQFNWGPGQQKAYQEIKQALLTAPALGLPDLTKPFELFVDEKQGYAKGALTPKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTGGSSLLQERQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPNSRLIN

SEQ ID NO: 127 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLRYVDDLLLAATSELDCQQGTRALLQTLGNLGYRASAKKAQICQKQVKYLGYLLKEGQRWLTETRKEAVMGQPTPKTPRQLREFLGTAGFCRLWIPGFAEMAAPLYPLTKTGTLFNWGPDQQKAYQEIKQALLTAPALGLPDLTKPFELIVDEKQGCAKGVLTQKLGPWRRPVAYLSKKLDPVAAGWPPCLRMVAAIAVLTKDAGKLTMGQPLVTLAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLIN

SEQ ID NO: 128 - protein, 683 aa, Artificial Sequence
  Mutant MLV reverse transcriptase
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGHRASAKKAQICQKQVKYLGYLLKEGQRWLTEARKETVMGQPTPKTPRQLREFLGTASFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVGALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLIENSSPNSRLIN

What is claimed is:

1. An isolated reverse transcriptase having an optimum activity at a temperature above 42° C., wherein the optimum activity at a temperature above 42° C. is an increased activity of the isolated reverse transcriptase compared to the activity of the isolated reverse transcriptase at 37° C., and wherein the reverse transcriptase comprises SEQ ID NO: 25 with at least one mutation selected from the group consisting of D200Q; D200V; D200 W; D200K; L603W; L603F; D653K; D653H; D200N, L603W; D200N, L603W, T330P; D200N, L603W, T330P, E607K; D200N, L603W, T330P, E607K, L139P; D200N, L603W, N479D, H594R; D200N, L603W, D653N, D524G; and D200N, L603W, D653N, D524G, T330P.

2. The reverse transcriptase according to claim 1, wherein the optimum activity is at a temperature in the range of from 50° C. to 60° C.

3. An isolated reverse transcriptase comprising SEQ ID NO: 25 with at least one mutation selected from the group consisting of L139P, D200A, G, Q, V, W or K, L603W or F, and D653K or H.

4. An isolated reverse transcriptase of claim 1, wherein the activity at 50° C. is at least 120% of the activity at 37° C.

5. The reverse transcriptase of claim 3 further comprising at least one mutation at an amino acid position selected from the group consisting of E5, M39, I49, M66, Q91, P130, I179, D200, Q221, Q237, T287, A307, T330, L333, Y344, Q374, W388, R390, Q430, D449, N479, A502, H594, L603, E607, A644, N649, D653, K658, L671, and E673.

6. The reverse transcriptase according to claim 5, having at least one mutation selected from the group consisting of E5K; M39V or L; I49V or T; M66L; Q91R or L; P130S; I179T or V; D200N; Q221R; Q237R; T287A; A307V; T330P; L333Q; Y344H; Q374R; W388R; R390W; Q430R; D449G or A; N479D; A502V; H594R or Q; L603M E607K, G or A; A644V or T; N649S; D653G, A or V; K658R or Q; L671P; and E673G or K.

* * * * *